(12) United States Patent
Sanz Molinero et al.

(10) Patent No.: US 9,428,763 B2
(45) Date of Patent: Aug. 30, 2016

(54) PLANTS HAVING ENHANCED YIELD-RELATED TRAITS AND A METHOD FOR MAKING THE SAME

(75) Inventors: Ana Isabel Sanz Molinero, Madrid (ES); Steven Vandenabeele, Oudenaarde (BE)

(73) Assignee: BASF Plant Science Company GmbH, Ludwigshafen (DE)

( * ) Notice: Subject to any disclaimer, the term of this patent is extended or adjusted under 35 U.S.C. 154(b) by 410 days.

(21) Appl. No.: 13/810,330

(22) PCT Filed: Jul. 13, 2011

(86) PCT No.: PCT/IB2011/053135
§ 371 (c)(1),
(2), (4) Date: Jan. 15, 2013

(87) PCT Pub. No.: WO2012/007916
PCT Pub. Date: Jan. 19, 2012

(65) Prior Publication Data
US 2013/0117888 A1    May 9, 2013

Related U.S. Application Data

(60) Provisional application No. 61/364,847, filed on Jul. 16, 2010, provisional application No. 61/366,962, filed on Jul. 23, 2010, provisional application No. 61/376,323, filed on Aug. 24, 2010.

(51) Int. Cl.
*C12N 15/82*    (2006.01)
*C07K 14/415*    (2006.01)

(52) U.S. Cl.
CPC ......... *C12N 15/8273* (2013.01); *C07K 14/415* (2013.01); *C12N 15/8243* (2013.01); *C12N 15/8261* (2013.01); *C12N 15/8271* (2013.01)

(58) Field of Classification Search
None
See application file for complete search history.

(56) References Cited

U.S. PATENT DOCUMENTS

| | | | |
|---|---|---|---|
| 7,214,786 B2 | 5/2007 | Kovalic et al. | |
| 7,253,342 B2 * | 8/2007 | Zhang et al. | 800/298 |
| 7,569,389 B2 | 8/2009 | Feldmann et al. | |
| 2006/0021088 A1 | 1/2006 | Inze et al. | |
| 2007/0214517 A1 | 9/2007 | Alexandrov et al. | |

OTHER PUBLICATIONS

Smidansky et al. Proc Natl Acad Sci U S A. 99(3):1724-9. Feb. 2002.*
Cordin et al. Gene. 367:17-37, Feb. 15, 2006.*
Friedberg. Automated protein function prediction—the genomic challenge. Brief. Bioinformatics. 7: 225-242, 2006.*
Hill et al. Functional analysis of conserved histidines in ADP-glucose pyrophosphorylase from *Escherichia coli*. Biochem. Biophys. Res. Comm. 244:573-577, 1998.*
Guo et al. Protein tolerance to random amino acid change, Proc. Natl. Acad. Sci. USA 101:9205-9210, 2004.*
Fourgoux-Nicol et al. 1999, Plant Molecular Biology 40: 857-872.*
"Populus trichocarpa Predicted Protein, mRNA", NCBI GenBank Accession No. XM_002312367, Feb. 26, 2009.
"Predicted Protein [Populus trichocarpa]", NCBI GenBank Accession No. XP_002314857, Feb. 25, 2009.
"Predicted: Hypothetical Protein [Vitis vinifera]", NCBI GenBank Accession No. XP_002274688, Mar. 20, 2009.
"*Zea mays* Hypothetical Protein LOC100383160 (LOC100383160), mRNA", NCBI GenBank Accession No. NM_001175825, Apr. 2, 2010.
"Oryza sativa Japonica Group Os07g0301200 (Os07g0301200) mRNA, Complete cds", NCBI GenBank Accession No. NM_001065959, Jun. 8, 2010.
International Search Report for PCT/IB2011/053135 mailed Jan. 5, 2012.
Negruk, V., et al., "Molecular Cloning and Characterization of the *CER2* Gene of *Arabidopsis thaliana*", The Plant Journal, 1996, vol. 9, No. 2, pp. 137-145.
Bourdenx, B., et al., "Overexpression of Arabidopsis *ECERIFERUM1* Promotes Wax Very-Long-Chain Alkane Biosynthesis and Influences Plant Response to Biotic and Abiotic Stresses", Plant Physiology, 2011, vol. 156, pp. 29-45.
International Preliminary Report on Patentability for PCT/IB2011/053135 Issued Jan. 22, 2013.
Piston, F., et al., "Down-Regulation of Four Putative Arabinoxylan Feruloyl Transferase Genes from Family PF02458 Reduces Ester-Linked Ferulate Content in Rice Cell Walls", Planta, 2010, vol. 231, pp. 677-691.

* cited by examiner

*Primary Examiner* — Medina A Ibrahim
*Assistant Examiner* — Wayne Zhong
(74) *Attorney, Agent, or Firm* — Drinker Biddle & Reath LLP

(57) ABSTRACT

Nucleic acids and the encoded CER2-like polypeptides, At1g68440-like polypeptides or DEAD-box RNA helicase polypeptides are provided. A method of enhancing yield-related traits in plants by modulating expression of nucleic acids encoding CER2-like polypeptides or At1g68440-like polypeptides is provided. A method of enhancing yield-related traits in plants by reducing or substantially eliminating expression of nucleic acids encoding DEAD-box RNA helicase polypeptides and/or the activity of DEAD-box RNA helicase polypeptides in said plants is provided. Plants with modulated expression of the nucleic acids encoding CER2-like polypeptides or At1g68440-like polypeptides have enhanced yield-related traits relative to control plants. Plants with reduction or elimination of the expression of endogenous nucleic acids encoding DEAD-box RNA helicase polypeptides have enhanced yield-related traits relative to control plants.

27 Claims, 61 Drawing Sheets

MGRSMLPEQQEDVSRKSKKEKKSKKDKKRKLEAEAEVVVEAAAATSTDEATKSSKKKRAKGDLGQGEEAENGGGKVVAVTGK

GSADAKYAPLSSFAATALPPQVLDCCKGFERPSPIQAYAWPYLLDGRDFIGIAATGSGKTIAFGVPALMHVRRKMGEKSAKKG
                                            _____MEME Motif 3_____
                                                  _____MEME Motif 6_____
                                                         _____MEME Motif 9_____

VPRVLVLSPTRELAQQIADVLCEAGAPCGISSVCLYGGTSKGPQISALKSGVDIVIGTPGRMKDLIEMGICRLNDVSFVVLDE
                                                                     _____

ADRMLDMGFEPEVRAILSQTASVRQTVMFSATWPPAVHQLAQEFMDPNPIKVVIGSEDLAANHDVMQIVEVLDDRSRDSRLVA
__MEME Motif 2__
 _MEME Motif 5_                                       _____MEME Motif 8_____

LLDKYHKAQRNRVLVFVLYKREATRVETMLQRRGWSAVSVHGDKAQHDRTKALSLFKEGSCPLMIATDVASRGLDIPDVEVVI
                                                                              _MEME_

NYSYPLTTEDYVHRIGRTGRAGKKGVAHTFFTQENKGLAGELVNVLREAGQVVPPALTKFGTHVKKKESQIYGSHFKEIKADA
_Motif 1_
 _MEME Motif 4_
_MEME Motif 7_

PKSTKITFGDSDED

FIGURE 1

```
Aquilegia_sp_TC27171#1_A                    ------------------------MGKKLEAVAQYGEP-------EETLD
V.vinifera_GSVIVT00003606001#1              ------------------------MGRRLEETVLHSEPVALQIPTNREIK
G.max_Glyma01g01390.1#1_A                   ------------------------MGRK-HDAVLASEPVAEEAPCSPELD
G.max_GM06MC17187_59654952@168              ------------------------MGRK-HDAVLVSEPVAEEVPYSPELD
M.truncatula_CU459038_20.4#1_A              ------------------------MARK-NDAVLSTEP-EQALNNNTELK
G.raimondii_TC4727#1_A                      MPPSIEQLTPETTSNPAFNAKKQDKKKKKKNKLPKAEDQIEENVKQSHQE
S.bicolor_Sb02g009590.1#1_A                 ------------------------MGR----NLDAEQA-------EAPRS
Z.mays_ZM07MC20090_BFb0116P06@              ------------------------MGR----NLPAEQV-------EAPRS
O.sativa_LOC_Os07g20580.1#1_A               ------------------------MGRS---MLPEQQE-------DVSRK
H.vulgare_TC183460#1_A                      ------------------------MDP----ELLSMQE-------ELSND
A.thaliana_AT1G31970.1#1_A                  ------------------------MAGQKQELPVSGEP----LAVESPMT
P.patens_205380#1_A                         --------------------------------------------MEVD
Chlorella_36420#1_A                         --------------------------------------------------
V.carteri_103394#1_A                        -----------------------------------------MVGDAQLA
O.lucimarinus_38084#1_A                     --------------------------------------------------
O.RCC809_33138#1_A                          --------------------------------------------------
O.taurii_19637#1_A                          --------------------------------------------------

Aquilegia_sp_TC27171#1_A                    FHKKKKKKNKNKKNE--EANNLKRKLEQEENEIVESNNNNNK--------
V.vinifera_GSVIVT00003606001#1              AEKKKKKKKHQSKIASNEVVEIGRKKKNEDYIIEEETEANRKRKLEETPT
G.max_Glyma01g01390.1#1_A                   SEKKKKKKKK-KNKNKDKHQTESSPKRKLDEH-DPQNGTESKKKK------
G.max_GM06MC17187_59654952@168              SEKKKKKKKRKNKNKDKHQTDSSTKRKLDEQLDPQNGTESNKKK------
M.truncatula_CU459038_20.4#1_A              SSKKKTKKN--------KHEETTPKRKHQDETNLQNDTESEKKS------
G.raimondii_TC4727#1_A                      NEEIQLKKSKDKKKRKKEKE-NNEGESEEVNHDESGEESKKEN------
S.bicolor_Sb02g009590.1#1_A                 SKKEKKSKKDKKRKLAAEAEEAAAAAVTAT---EETVKSIKKKKL-----
Z.mays_ZM07MC20090_BFb0116P06@              SKMDKKKKKDKKRKLAAEAEEEA--AVTAT---VETVKSSKKKR------
O.sativa_LOC_Os07g20580.1#1_A               SKKEKKSKDKKRKLEAEAEVVVVEAAAATSI-DEATKSSKKKR------
H.vulgare_TC183460#1_A                      RKKDTKSKKAKKPKPAADEAAAEEDDLSNKRKKDKKSKKDKKRKL-----
A.thaliana_AT1G31970.1#1_A                  NKKKKKKSKKNKHTEENHEVEEVPQEVTNGVEEELSNKEKKKKRKR----
P.patens_205380#1_A                         VEKKKKKKRNKKSKKKQKSEVGSVAKTSAVAAEVVAN------------
Chlorella_36420#1_A                         --------------------------------------------------
V.carteri_103394#1_A                        NAGKPIIKSLYNEHPDVTAFTAERVAEVRSERRITIEGFGPEDDF-----
O.lucimarinus_38084#1_A                     ------------------MSASEVQAARDALAVTQV-------------
O.RCC809_33138#1_A                          ------------------MSASDLAAAREKLAVTQV-------------
O.taurii_19637#1_A                          ------------------MSAKDVAAARETLAITQV-------------

Aquilegia_sp_TC27171#1_A                    -----KKKNKKNSEESVG----VLEEEGKKQESEND--GKEVFVSGNNI
V.vinifera_GSVIVT00003606001#1              VTEAKKKKKEKKKEKKEK----EGEEEEGLKDEDDKESRGACVAVTGKDA
G.max_Glyma01g01390.1#1_A                   ----KKHHESKGNAEETNGDSNNNNGDGANREETATD---GSVVVTGNNA
G.max_GM06MC17187_59654952@168              ----KKHHESKENAEETNG--NNNSDNGANRDETVAD---GSVVVTGLNA
M.truncatula_CU459038_20.4#1_A              ----KKKK--KHKSEENN-------DAGGVSVSASD---EPIVVTGKNA
G.raimondii_TC4727#1_A                      ----KKKTLKKQKKEEENG---DSIETANGKEDSVQFDDKEKVVVSGKNA
S.bicolor_Sb02g009590.1#1_A                 ----VENGAGAGGGGEAEN-----------------GAEKTVAVTGKGS
Z.mays_ZM07MC20090_BFb0116P06@              ----VENEPGAG-AVEAEN-----------------GAEKTVAVTGKGS
O.sativa_LOC_Os07g20580.1#1_A               ----AKGDLGQG--EEAEN-----------------GGGKVVAVTGKGS
H.vulgare_TC183460#1_A                      ----AAENEEAATEEEGKSS---KKRGVTKEEPDQVGAVEKSVAVTGKGF
A.thaliana_AT1G31970.1#1_A                  ----EEKESEKNKKKDVPE------KKLEAEDLGEGESEQQKVVVTGKGV
P.patens_205380#1_A                         ---------EKLS---------------------------VVVTGSGS
Chlorella_36420#1_A                         --------------------------------------------------
V.carteri_103394#1_A                        ------------------------------------------EAG
O.lucimarinus_38084#1_A                     ------------------------------------------DG
O.RCC809_33138#1_A                          ------------------------------------------DG
O.taurii_19637#1_A                          ------------------------------------------EG
```

FIGURE 2

```
Aquilegia_sp_TC27171#1_A            NESKYKALSSFEEAKLPDEVLQCCKSFSKPSPIQSHAWPYLLDGRDFIGI
V.vinifera_GSVIVT00003606001#1      KESKYAAFKSFAESKLPDDVLECCCRNFSQPSPIQSHAWPFLLDERDFIGI
G.max_Glyma01g01390.1#1_A           GEAKYAAVKSFADSGLPENVLECCCKGFEKPSPIQSRAWPFLLDGRDLIGI
G.max_GM06MC17187_596654952@168     GDAKYAAVKSFADSGLPENVLECCCKGFQKPSPIQSRAWPFLLDGRDLIGI
M.truncatula_CU459038_20.4#1_A      GDEKYTPVKRFEDSGLPENVLECCCKGFEKPSPIQSRAWPFLLDGRDLIGI
G.raimondii_TC4727#1_A              EEAKYAPLKSFSNSKLPKNVLDCCCKGFSSPSPIQAHAWPFLLDGRDFIGI
S.bicolor_Sb02g009590.1#1_A         EDPKYAPLRSFSAAELPSQVLDCCSAFARPSPIQAHAWPFLLDGRDFIGI
Z.mays_ZM07MC20090_BFb0116P06@      EDPKYAPLRSFSAAELPSQVLECCSAFARPSPIQAHAWPFLLDGRDFIGI
O.sativa_LOC_Os07g20580.1#1_A       ADAKYAPLSSFAATALPPQVLDCCCKGFERPSPIQAYAWPYLLDGRDFIGI
H.vulgare_TC183460#1_A              ADPKYAPLKSFAAAALPTQVLDCCCKGFDRPSPIQALAWPYLLDGRDFIGI
A.thaliana_AT1G31970.1#1_A          EEAKYAALKTFAESNLPENVLDCCCKTFEKPSPIQSHTWPFLLDGRDLIGI
P.patens_205380#1_A                 DNPKFKKQENFKLEGVPPTVLQCCQGFEKPSPIQGHAWPFLLAGRDLIGI
Chlorella_36420#1_A                 MPTPVPPCS----TGLSAAELHATRSFQHPSPIQAQCLPLALSGRDLVGI
V.carteri_103394#1_A                GPTDIKPVLAFEHTGLPSDMLHATRNFVSPSPIQAQCWPIILAGRDLIGI
O.lucimarinus_38084#1_A             LSTDLAPVSSFADAGFSKELLRVTAQFKTPSPIQAQSWPIIMSGHDMVGI
O.RCC809_33138#1_A                  LETDLAPVSTFADAGFCKELLRVTAQFQKPSPIQAQSWPIVMSGHDMVGI
O.taurii_19637#1_A                  LDVDLAPVSTFEDAGFSKELLRVTANFQKPSPIQAQSWPIVMSGRDMVGI
                                       .   *   *  ***** .    * :  :*::**

Aquilegia_sp_TC27171#1_A            AATGSGKTLAFGIPALMHIRHSVNQK--TTRRVNPLCLVLSPTRELAQQI
V.vinifera_GSVIVT00003606001#1      AATGSGKTLAFGVPAMMHVLSKRKSK--TSKGVNPLCLVLSPTRELAQQI
G.max_Glyma01g01390.1#1_A           AATGSGKTLAFGIPAVMHVLGKRKGK--SSKGRNPLGLVLSPTRELAQQI
G.max_GM06MC17187_596654952@168     AATGSGKTLAFGLPAVMHVLGKRKGK--SSKGRNPLGLVLSPTRELAQQI
M.truncatula_CU459038_20.4#1_A      AATGSGKTLAFGIPAIMHVMNKRKSKG-SSKGRNPLCLMLSPTRELAQQI
G.raimondii_TC4727#1_A              AKTGSGKTLAFGVPAMMLVLNQRNGK--SSKGKNPLCLVLSPTRELAEQI
S.bicolor_Sb02g009590.1#1_A         AATGSGKTIAFGVPALMHIRKKVGGK--AVKKAVPRCLVLSPTRELAQQI
Z.mays_ZM07MC20090_BFb0116P06@      AATGSGKTIAFGVPALMHIRKKVGGK--AGKKAVPRCLVLSPTRELAQQI
O.sativa_LOC_Os07g20580.1#1_A       AATGSGKTIAFGVPALMHVRKKMGEK--SAKKGVPRVLVLSPTRELAQQI
H.vulgare_TC183460#1_A              AATGSGKTIAFGVPALMHVRKKLSEK--GAKKGLPRCLMLAPTRELAQQI
A.thaliana_AT1G31970.1#1_A          AKTGSGKTLAFGIPAIMHVLKKNKKIGGGSKKVNPTCLVLSPTRELAVQI
P.patens_205380#1_A                 AATGSGKTLAFGIPAMKHVLDKITKT--KGKKAAPVCLVLAPTRELAQQI
Chlorella_36420#1_A                 AATGSGKTLAFGLPALRHIRAQSEAGVATGKK--PVALVIAPTRELALQI
V.carteri_103394#1_A                AATGSGKTLGFGLPMLRHIAAQRDNGVVSGKG--PFAIVMAPTRELALQI
O.lucimarinus_38084#1_A             AATGSGKTLAFGMPALTQIHSQP--PCKPGQ---PICLVLAPTRELAQQT
O.RCC809_33138#1_A                  AATGSGKTLAFGMPALTQIRSQP--ACKPGE---PICLVLAPTRELAQQT
O.taurii_19637#1_A                  AATGSGKTLAFGMPALTQIRSQP--PCKPGQ---PICLVLAPTRELAQQT
                                    * *****:.**:* :   :  .       .  *  ::::.****** *

Aquilegia_sp_TC27171#1_A            ADVLCEAGKSCGARSVCLYGGTSKGPQISALKAG--VDIVIGTPGRLKDL
V.vinifera_GSVIVT00003606001#1      SDVLCEAGKHCGVKSVCLYGGTSKGPQISSLKSG--VDIVIGTPGRLKDL
G.max_Glyma01g01390.1#1_A           SDVMCDAGRSCGVQSICLYGGTSKGPQISSLKSG--IDIVIGTPGRIQDL
G.max_GM06MC17187_596654952@168     SDVMCDAGRSCGVQSICLYGGTSKGPQISSLKSG--IDIVIGTPGRIQDL
M.truncatula_CU459038_20.4#1_A      SDVLCDAGKSCGVESVCLYGGTPKGAQISALKSG--IDIVIGTPGRIQDL
G.raimondii_TC4727#1_A              FNVLCNAGQACDVKSVCLYGGTAKGPQISSLKSG--VDIVIGTPGRLKDL
S.bicolor_Sb02g009590.1#1_A         ADVLSEAGAPCGIKSVCLYGGTKKEPQISALKSG--VDIVIGTPGRMKDL
Z.mays_ZM07MC20090_BFb0116P06@      SDVLSEAGAPCGIKSVCLYGGTKKEPQISALKSG--VDIVIGTPGRMKDL
O.sativa_LOC_Os07g20580.1#1_A       ADVLCEAGAPCGISSVCLYGGTKKGPQISALKSG--VDIVIGTPGRMKDL
H.vulgare_TC183460#1_A              ADVLTEAGAPCGINSVCLYGGTSKGPQISSLKSG--VEIVIGTPGRMKDL
A.thaliana_AT1G31970.1#1_A          SDVLREAGEPCGLKSICVYGGSSKGPQISAIRSG--VDIVIGTPGRLRDL
P.patens_205380#1_A                 ADVLEESGSACGVGVVCVYGGTPKGPQRSALKAG--ARVVVATPGRLQDL
Chlorella_36420#1_A                 CAVLEEAGSQCGISTVCVYGGVPKREQVAALRKG--AAIVVATPGRLEDL
V.carteri_103394#1_A                NQVLEEAGSQCSVRTVCVYGGVPKGPQVAALKSG--VEVVVGTPGRMEDL
O.lucimarinus_38084#1_A             AKVFDDAGEASGVRCVCVYGGAPKYEQKAQMKAGGGAAVIVATPGRLRDF
O.RCC809_33138#1_A                  ARVFDDAGEASGVRCVCVYGGSPKHEQKAAMKAGGGATVIVATPGRLRDF
O.taurii_19637#1_A                  AKVFDDAGEASGVRCVCVYGGAPKYEQKNAMKAGGGAAVIVATPGRLRDF
                                     *:  ::*    ..    :*:***  *    ::  *    :::.****:.*:
```

FIGURE 2 (continued)

```
Aquilegia_sp_TC27171#1_A              MEMGFCRLQEVSYVVLDEADRMLDMGFEPEVRSILSQTCSVRQMVMFSAT
V.vinifera_GSVIVT00003606001#1        IEMGVCCLTEVSFVVLDEADRMLDMGFEPEVRSILSQTCPARQMVMFSAT
G.max_Glyma01g01390.1#1_A             IEMGICCLKEVSFVVLDEADRMLDMGFEQIVRSILGQTCSDRQMVMFSAT
G.max_GM06MC17187_596549520168        IEMGICCLKEVSFVVLDEADRMLDMGFEQIVRSILGQTCSDRQMVMFSAT
M.truncatula_CJ459038_20.4#1_A        VEMGICRLQEVSFVVLDEADRMLDMGFEQIVRSILGQTCSARQMVMFSAT
G.raimondii_TC4727#1_A                MNMEVCQLNEVSFVVLDEADRMLDMGFEEDVRFILGKTCSARQMVMFSAT
S.bicolor_Sb02g009590.1#1_A           IEMGVCRLNEVSFVVLDEADRMLDMGFEPEVRAILSQTSSVRQMVMFSAT
Z.mays_ZM07MC20090_BFb0116P06@        IEMGVCCLNEVSFVVLDEADRMLDLGFEPEVRAILSQTSSVRQMVMFSAT
O.sativa_LOC_Os07g20580.1#1_A         IEMGICRLNDVSFVVLDEADRMLDMGFEPEVRAILSQTASVRQTVMFSAT
H.vulgare_TC183460#1_A                IEMGVCRLNEVSFVVLDEADRMLDMGFEPEVRAILSQTSSVRQMVMFSAT
A.thaliana_AT1G31970.1#1_A            IESNVLRLSDVSFVVLDEADRMLDMGFEEPVRFILSNTNKVRQMVMFSAT
P.patens_205380#1_A                   MEEGVCSLDQVTYVVLDEADRMLDLGFEPAIRAILSTCCQVRQTVMFSAT
Chlorella_36420#1_A                   LEDGACRLDEVSYLVLDEADRMLDLGFEPHIRAIAGKTRADRQTLMFSAT
V.carteri_103394#1_A                  LNDGVLQLKKVTYAVLDEADRMLDLGFEPHIRAIMGLTRADRQTLMFSAT
O.lucimarinus_38084#1_A               MEEGVIKLDRVTMLVLDEADRMLDLGFEPEIRAIAGATRADRQTVMFSAT
O.RCC809_33138#1_A                    MEEGVIKLHRVTMLVLDEADRMLDLGFEPEIRAIAGATRADRQTVMFSAT
O.taurii_19637#1_A                    MEEGVIKLDRVTMLVLDEADRMLDLGFEPEIRAIAGATRADRQTVMFSAT
                                       ::    *  *:  **********:***  :* *  .    ** :*****

Aquilegia_sp_TC27171#1_A              WPSSVHQLAQEFMDP-NPVKVVVGSEDLAANHDVMQIVEVLDDRARDARL
V.vinifera_GSVIVT00003606001#1        WPLPVHQLAQEFMDP-NPVKVVIGSEDLAANHDVMQIVEVLDDRSRDERL
G.max_Glyma01g01390.1#1_A             WPLPVHYLAQEFMDP-NPVKVVVGSEDLAANHDVMQIVEVLDDRSRDKRL
G.max_GM06MC17187_596549520168        WPLPVHYLAQEFMDP-NPVKVVVGSEDLAANHDVMQIVEVLDDRSRDKRL
M.truncatula_CJ459038_20.4#1_A        WPLAVHHLAQEFMDP-NPVKVVVGSEDLSANHDVMQIVEVLDERLRDKRL
G.raimondii_TC4727#1_A                WPAAVHRLAQEYMDF-NPVKVVIGSEDLAANHDVMQIVEVLDDRARYERL
S.bicolor_Sb02g009590.1#1_A           WPLAVHKLAQEFMDP-NPIKVVIGSEDLAANHDVMQIVEVLDDRTRDSRL
Z.mays_ZM07MC20090_BFb0116P06@        WPLAVHKLAQEFMDP-NPIKVVIGSEDLAANHDVMQIVEVLDDRTRDSRL
O.sativa_LOC_Os07g20580.1#1_A         WPPAVHQLAQEFMDP-NPIKVVIGSEDLAANHDVMQIVEVLDDRSRDSRL
H.vulgare_TC183460#1_A                WPFAVHQLAQEFMDP-NPIKVVVGSEDLAANHDVMQIVEVLDDRARDSRL
A.thaliana_AT1G31970.1#1_A            WPLDVHKLAQEFMDP-NPIKVIIGSVDLAANHDVMQIIEVLDERARDQRL
P.patens_205380#1_A                   WPMAVSKLAMEFMNEKDPVKVMVGSQDLAANHDVTQIVEVIEDRARDARL
Chlorella_36420#1_A                   WPPAIRKLASEFLCH--PVRVTIGSQDLAASHSVTQVIEVIEDRARDGRL
V.carteri_103394#1_A                  WPAAVQKLAIAFLSH--PVKVTIGSQDLAASHSITQRVDVIDPNARDGRL
O.lucimarinus_38084#1_A               WPQSVQSLASEFMCN--PIKVRIGAEGLKASQSITQIVEVVEPQDKDRHL
O.RCC809_33138#1_A                    WPQSVQSLAAEFMHE--PVKVRIGAEGLKASQSITQIVEVVEPQDKDRHL
O.taurii_19637#1_A                    WPMSVQSLASEFMCN--PVRVRIGSEGLKASQSITQIVEVVEPQDKDRHL
                                      **  :  **   ::     *::*  :*:  .*  *..: *  ::*:: . :   :*

Aquilegia_sp_TC27171#1_A              IALLEKYEKS--QKNRVLVFVLYKKEAARVENMLQRSGFKAVSVHGDKAQ
V.vinifera_GSVIVT00003606001#1        LILLGKYEKS--QRNRVLVFVLYKKEAARVENMLQRRGWNVVSIHGDKAQ
G.max_Glyma01g01390.1#1_A             VALLEKYEKS--QRNRVLVFVLYKLEAKRVENMLQEGGWKVVSIHGDKAQ
G.max_GM06MC17187_596549520168        AALLEKYEKS--QRNRVLVFVLYKLEAKRVENMLQEGGWKVVSIHGDKAQ
M.truncatula_CJ459038_20.4#1_A        LALLEKYEKS--QKNRVLVFVLYKWETTRVEKMLQQGGWKAVSISGDKSQ
G.raimondii_TC4727#1_A                TALLKKYEKS--QRNRVLVFVLYQAEADRIENMLKRSGWNVVSIHGDRKAQ
S.bicolor_Sb02g009590.1#1_A           LALLDKYEHA--QSNRVLVFVLYKKEAARVETMLQRRGWKAVSVHGDKAQ
Z.mays_ZM07MC20090_BFb0116P06@        LALLDKYEHQA--Q--RVLVFVLYKKEAARVETMLQRRGWKAVSVHGDKAQ
O.sativa_LOC_Os07g20580.1#1_A         VALLDKYEKA--QRNRVLVFVLYKREATRVETMLQRRGWSAVSVHGDKAQ
H.vulgare_TC183460#1_A                VALLDKYEKS--QSNRVLVFVLYKKEAGRVEAMLNKRGWKAVSVHGDKAQ
A.thaliana_AT1G31970.1#1_A            IALLEKYEKS--QKNRVLVFALYKVEAERLERFLQQRGWKAVSIHGNKAQ
P.patens_205380#1_A                   ETLLQKYEKS--RTNRVLVFVLYKKEAVRVETALQRRGWKVSAVHGDKGQ
Chlorella_36420#1_A                   HELLQRYEAS--RSNRVIIFVLYKKEAVREQLLQRKGWKAAAIHGDISQ
V.carteri_103394#1_A                  LELLQQYEGAKGRKNRVIIFVLYKKEAPRVEQLLSRKGWKAVAIHGDISQ
O.lucimarinus_38084#1_A               ARVMKQYLGKGKEVPRTLIFGLYKKECANLEQRLSR-EWPAVCIHGDMSQ
O.RCC809_33138#1_A                    ARVMKQYLGKGKDVPRTLVFCLYKKECANLEMRLAR-EWPAVCIHGDMSQ
O.taurii_19637#1_A                    ARVMKQYLGSPKDCPRTLIFGLYKKECANLEQRLSR-EWPAVCIHGDMSQ
                                      :: :*       *.::* **: * ..:.  * .  :.  :* .*
```

FIGURE 2 (continued)

```
Aquilegia_sp_TC27171#1_A              RDRTNALGLFKEGTCPLMVATDVAARGLDIPDVEVVINYSFPLTTEDYVH
V.vinifera_GSVIVT00003606001#1        QARTAALSLFKKGSCPLMIATDVAARGLDIPDVEVVINYSFPLTTEDYVH
G.max_Glyma01g01390.1#1_A             HDRTKALSLFKNASCPLMIATDVAARGLDIPDVEVVINYSFPLTTEDYVH
G.max_GM06MC17187_59654952@168        HDRTKALSLFKNGSCPLMIATDVAARGLDIPDVEVVINYSFPLTTEDYVH
M.truncatula_CJ459038_20.4#1_A        HERTKALSLFKNGSCPLMIATDVAARGLDIPDVEVVINFSFPLTLEDYVH
G.raimondii_TC4727#1_A                NERTKALSLFKKGSCPLMVATDVAARGLDIPDVEVVINYSFPLATEDYVP
S.bicolor_Sb02g009590.1#1_A           HDRTKALSLFKEGKCPLMIATDVASRGLDIPDVEVVINYSYPLTTEDYVH
Z.mays_ZM07MC20090_BFb0116P06@        HDRTKALSLFKEGKCPLMIATDVASRGLDIPDVEVVINYSPLTTEDYVH
O.sativa_LOC_Os07g20580.1#1_A         HDRTKALSLFKEGSCPLMIATDVEVVINYSYPLTTEDYVH
H.vulgare_TC183460#1_A                HDRTKALSLFKEGKCPLMIATDVASRGLDIPDVEVVINYSFPLTTEDYVH
A.thaliana_AT1G31970.1#1_A            SERTRSLSLFKEGSCPLLVATDVAARGLDIPDVEVVINYTFPLTTEDYVH
P.patens_205380#1_A                   SDRTRAVNSFKDGTRPLLIATDVAARGLDIPDVEYVINYSFPLTTEDYVH
Chlorella_36420#1_A                   VQRSSAVEQFKSGAVPLLVATDVAARGLDIPDVEAVLNYSFPLTTEDYVH
V.carteri_103394#1_A                  QQRTDAVDKFKSGVVPLLIATDVAARGLDIPDVEVVINYSFPLTTEDYVH
O.lucimarinus_38084#1_A               HDREKSVDAFKKGTSRILIATDVAARGLDIKEVEYVINYTFPLTTEDYVH
O.RCC809_33138#1_A                    LDREKSVDAFKKGTSRILIATDVAARGLDIKEVEYVINYTFPLTTEDYVH
O.taurii_19637#1_A                    ADRERSVEAFKKGTSRILIATDVAARGLDIKGVEYVINYTFPLTTEDYVH
                                       *  ::  **..   :::*****:*****  ** *:*::***: ****

Aquilegia_sp_TC27171#1_A              REGRTGRAGKKGVAHTFFM-QENKGLAGELVNVLREAGQIVPTDLTKFGT
V.vinifera_GSVIVT00003606001#1        REGRTGRAGKKGVAHTFFM-QENKGLAGELVNVLREAGQIVPADLLKFGT
G.max_Glyma01g01390.1#1_A             REGRTGRAGKKGVAHTFFM-QQNKGLAGELVNVLREAGQIVPDALLKFGT
G.max_GM06MC17187_59654952@168        REGRTGRAGKNSLCS------RIRDLLGSW--------------------
M.truncatula_CJ459038_20.4#1_A        REGRTGRAGKKGVAHTFFT-HLNKGLAGELVNVLREAGQVVPDDLLKFGT
G.raimondii_TC4727#1_A                REGRTGRAGRKGVAHPFFT-QQNKGLAGELVNVLREAGQVVPPALLKFGT
S.bicolor_Sb02g009590.1#1_A           REGRTGRAGKKGVAHTFFT-QANKALAGELVNVLREADQVVPPALMKFGT
Z.mays_ZM07MC20090_BFb0116P06@        REGRTGRAGKKGVAHTFFT-QANKALAGELVNVLREADQVVPPALMKFGT
O.sativa_LOC_Os07g20580.1#1_A         REGRTGRAGKKGVAHTFFT-QENKGLAGELVNVLREAGQVPPALTKFGT
H.vulgare_TC183460#1_A                REGRTGRAGKKGVAHTFFT-QADKGLAGELVNVLREADQVVPPALTKFGT
A.thaliana_AT1G31970.1#1_A            REGRTGRAGKKGVAHTFFT-PLNKGLAGELVNVLREAGQVVPADLLKFGT
P.patens_205380#1_A                   REGRTGRAGKKGLSHTFFT-QADRARAGELVNVLREAGQTVPEELLKFGT
Chlorella_36420#1_A                   REGRTGRAGXTGKAHTFFVGNNDKPRAGELINVLREAKQTVPEELLKFGT
V.carteri_103394#1_A                  REGRTGRAGXTGIAHTFFCAGPDKPRAGELINVLREAGQEVPAELLKFGT
O.lucimarinus_38084#1_A               REGRTGRAGATGLAHTFFT-LHDKARAGELVNVLRKAGAEVPEELTKFGT
O.RCC809_33138#1_A                    REGRTGRAGATGLAHTFFT-VHDKARAGELVNVLRKAGAEVPDDLTKFGT
O.taurii_19637#1_A                    REGRTGRAGATGLAHTFFT-QHDKARAGELVNVLRKAGAEVPEDLTKFGT
                                      ********   ..  .          :     *.

Aquilegia_sp_TC27171#1_A              HVKKKESKLYGAHFKEISVDAPKSKKITFDNSDED-
V.vinifera_GSVIVT00003606001#1        HVKKKESKLYGAHFREIAADAPKSKKITFDDSDED-
G.max_Glyma01g01390.1#1_A             HVKKKESKLYGAHFKEIPVDAPKSQKKTFDDSDED-
G.max_GM06MC17187_59654952@168        ------------------------------------
M.truncatula_CJ459038_20.4#1_A        HVKKKESKLYGAHFKEIPVDAPKSKKITFDNSDDED
G.raimondii_TC4727#1_A                HVKKKESKLYGAHFKEIAADAPKAKKITFDDSDDEN
S.bicolor_Sb02g009590.1#1_A           HVKKKESKLYGSHFKEITADAPKSTKITFGDSDED-
Z.mays_ZM07MC20090_BFb0116P06@        HVKKKESKIYGSHFKEITADAPKSTKITFGDSDED-
O.sativa_LOC_Os07g20580.1#1_A         HVKKKESQIYGSHFKEITADAPKSTKITFGDSDED-
H.vulgare_TC183460#1_A                HVKKKESKIYGSHFKEITADAPKSTKITFGDSDEE-
A.thaliana_AT1G31970.1#1_A            HVKKKESKLYGAHFKEIAADAPKATKITFDNSDDED
P.patens_205380#1_A                   HVKKKESKLYGAHFKEIGADSGKAKKITFGDSDDE-
Chlorella_36420#1_A                   TVKKKESKLYGAHFKDVDHS-QKATKISFDSDDE--
V.carteri_103394#1_A                  AVKKKESKMYGAHFRDVDVH-AKASKVTFDDD----
O.lucimarinus_38084#1_A               HVKKKESKLYGAHFKDVDMS-VKATKITFD------
O.RCC809_33138#1_A                    HVKKKESKLYGAHFKEVDMS-VKAKKITFD------
O.taurii_19637#1_A                    HVKKKESKLYGAHFKEVDMT-VKATKITFD------
```

FIGURE 2 (continued)

|    | 1    | 2    | 3    | 4    | 5    | 6    | 7    | 8    | 9    | 10   | 11   | 12   | 13   | 14   | 15   | 16   | 17   |
|----|------|------|------|------|------|------|------|------|------|------|------|------|------|------|------|------|------|
| 1. |      | 67.1 | 46.7 | 67.5 | 56.0 | 64.7 | 64.0 | 68.6 | 42.7 | 43.8 | 66.5 | 44.0 | 57.2 | 66.8 | 48.9 | 67.9 | 66.7 |
| 2. | 79.9 |      | 49.2 | 71.2 | 60.3 | 65.4 | 69.1 | 70.5 | 45.0 | 46.5 | 71.5 | 47.1 | 60.8 | 71.5 | 50.4 | 72.5 | 70.1 |
| 3. | 59.2 | 61.1 |      | 46.7 | 38.8 | 43.2 | 48.1 | 48.3 | 56.3 | 55.0 | 48.9 | 57.5 | 58.4 | 50.7 | 65.6 | 46.0 | 50.9 |
| 4. | 79.9 | 81.4 | 60.7 |      | 82.6 | 66.5 | 67.6 | 78.5 | 42.3 | 43.4 | 68.7 | 43.1 | 58.8 | 67.8 | 48.7 | 73.7 | 67.8 |
| 5. | 69.6 | 73.1 | 57.9 | 84.9 |      | 55.4 | 57.6 | 66.6 | 35.9 | 35.9 | 57.5 | 35.7 | 49.4 | 57.0 | 40.5 | 62.7 | 57.2 |
| 6. | 78.0 | 76.6 | 55.1 | 77.7 | 66.5 |      | 64.2 | 66.0 | 39.4 | 40.3 | 63.5 | 40.1 | 53.6 | 64.5 | 45.5 | 68.9 | 62.9 |
| 7. | 80.1 | 80.6 | 61.5 | 78.2 | 69.8 | 75.0 |      | 66.9 | 45.3 | 45.5 | 79.1 | 45.5 | 60.2 | 79.1 | 50.4 | 67.3 | 78.1 |
| 8. | 80.1 | 80.8 | 63.1 | 86.8 | 76.7 | 77.7 | 79.1 |      | 43.6 | 44.8 | 68.1 | 45.2 | 59.1 | 68.2 | 51.1 | 69.1 | 67.0 |
| 9. | 57.2 | 59.4 | 70.5 | 57.0 | 55.1 | 53.2 | 58.7 | 59.5 |      | 92.0 | 45.7 | 92.0 | 52.5 | 46.9 | 53.5 | 42.1 | 46.9 |
| 10.| 57.4 | 60.0 | 69.8 | 57.4 | 55.6 | 53.7 | 59.1 | 60.8 | 96.4 |      | 45.5 | 90.9 | 54.0 | 46.5 | 53.0 | 42.7 | 47.3 |
| 11.| 78.6 | 82.9 | 63.3 | 77.8 | 70.5 | 75.0 | 86.2 | 78.6 | 60.5 | 60.7 |      | 46.5 | 61.2 | 84.5 | 51.0 | 68.5 | 83.8 |
| 12.| 58.8 | 60.8 | 71.1 | 57.4 | 54.9 | 53.5 | 59.1 | 61.2 | 95.7 | 94.8 | 61.5 |      | 53.5 | 46.9 | 53.9 | 43.4 | 47.3 |
| 13.| 70.4 | 73.0 | 67.8 | 71.3 | 67.4 | 65.8 | 73.6 | 73.2 | 65.1 | 67.0 | 75.4 | 66.8 |      | 61.8 | 58.0 | 57.5 | 61.9 |
| 14.| 78.6 | 80.2 | 63.3 | 76.5 | 69.1 | 73.8 | 84.9 | 78.6 | 60.7 | 60.5 | 89.5 | 61.5 | 76.2 |      | 52.4 | 69.2 | 95.1 |
| 15.| 65.0 | 67.6 | 73.6 | 64.2 | 61.5 | 60.8 | 66.6 | 69.0 | 66.3 | 65.7 | 67.4 | 66.7 | 70.5 | 67.2 |      | 50.4 | 52.5 |
| 16.| 81.1 | 81.2 | 59.0 | 83.2 | 71.4 | 80.3 | 77.6 | 79.4 | 54.8 | 56.1 | 77.2 | 56.8 | 68.3 | 76.7 | 64.1 |      | 68.9 |
| 17.| 77.8 | 79.2 | 64.4 | 77.8 | 71.9 | 73.8 | 84.5 | 77.6 | 61.3 | 61.9 | 89.1 | 62.1 | 76.1 | 96.3 | 67.2 | 76.9 |      |

FIGURE 4

MGSLPNLEAPPPSSSRISTVVPATPRCEEKGEHNLNYMDLLMKLHYVRSIYFFDSEAVQGLTISDL
```
                                        -------6--------
```

KTPMFPLLDLYSHVAGRVRIAKSGRPFIKCNDAGVRIAESQCDKTLREWLDENEYSVDELVHDHVL
```
            ---------2-----------
            -----------5-----------
```

GPDLAFSPLVFVKFTSFKCGGLSVGLSWAHILGDAFSAFNFITKWSHILAGQSQPKSLHIPNLVKP
```
                ----------------1-------------
                --------------------4-----------------
```

QFLSNFVFDNPISIKNENVVGEYWLAANDCYVPSHTFHITSSQLHHLVKTTKSITNTDTKYFEIIS
```
                                                          ------3--
```

ATIWKCIAQIRGDIGPKVVTICSKNKNTSKCAENEFPTNDILLSKIETNLRPEEYNILDLMNLIGE
```
------------
```

KKINENYALEKLVEKGDGKDDFFVYGAKLTFVDLEEADLYGVKLNGKKPIRANCDLRGVGDQGVVL

VFPGPEDDDGNNGRMIKVSLPGKELDQLKYKLEREWGIQHYASLTF

```
V.vinifera_GSVIVT00017176001#1_B        M.............................................VKLM.ATYTVRPAKETPG
Aquilegia_sp_TC20397#1_B                M.............................................VMVSIK.RTCTVKPNEKTPD
G.max_Glyma08g42490.1#1_B               M.............................................VTIV.GSYNVTPNQPTPK
G.max_GM06MC27564_sae62b11@26939#1_B    M.............................................VTIK.ASYTVLPNEPTPE
A.thaliana_AT5G48930.1#1_B              M.............................................KINIR.DSTMVRPATETPI
P.trichocarpa_587193#1_B                M.............................................IINVK.ESTMVQPAEETPR
G.max_Glyma13g44830.1#1_B               M.............................................LINVK.QSTMVRPAEETPR
P.vulgaris_TC13456#1_B                  M.............................................TITVK.ESTMVQPAEGTPR
L.sativa_TC19194#1_B                    M........................................TIGTDSEKMNLTVK.ESVTVKPSKQTPN
S.lycopersicum_TC201861#1_B             M.........................................GSEKMMKINIK.ESTLVKPSKPTPT
P.trichocarpa_784746#1_B                M..........................................QMVRVEIRTK.QSTIVRPAEDTPK
G.hirsutum_TC130878#1_B                 M.............................................DVSVK.RWSMIRPAQDTPK
M.esculenta_TA8094_3983#1_B             M.............................................KINIK.ESSLIHPAEDLPN
M.truncatula_AC148816_16.4#1_B          M..........................................VNIHIY.RSYTVTPSEKTPT
A.thaliana_AT5G41040.1#1_B              MVAENNKNKDVTLSASMDNNNNNIKGTNIHLEVHQK.EPALVKPESETRK
A.thaliana_AT5G63560.1#1_B              M..........................................ADSFELIVTRK.EPVLVSPASETPK
B.napus_BN06MC25915_512674770@25820#1_B M..........................................AGSFEFVVTRK.NPVLVTPKSETPK
G.max_Glyma05g38290.1#1_B               M.............................................ANKLNIRLG.EPTLVPPAEETEK
P.trichocarpa_807676#1_B                M.....................................EGTGKHGGDQLSVKKS.EPVLIEPETRTHS
P.patens_TC44371#1_B                    M............................................RIERR.FRRVVKPADRSNA
S.moellendorffii_431283#1_B             M..........................................SNVVHIA.SVCTIVPAIPTRQ
B.napus_TC72743#1_B                     M.............................................KVETIKPSSTTPD
P.trichocarpa_768990#1_B                M...........................................SVPMRIEIM.QRETIKPSSPTPL
V.vinifera_GSVIVT00035108001#1_B        M......DFGKCSKSAKEDCSCCPLLKTTMEMKIDIL.STQPIKPSSPTPN
P.trifoliata_TA5574_37690#1_B           M.............................................DLQIT.CTEIIKPSSPTPQ
P.trichocarpa_579978#1_B                M.............................................KIEIT.SRKWITPSSPTPP
```

FIGURE 8 (continued)

```
                                                    51                                                      100
M.truncatula_CU137640_9.3#1_A                       ..EN.SAYNLNYMDLLMKLHY...IRSIYLF.NS......KAVQNLSIS
M.truncatula_transferase_CER2-like#1_A              ..EK.GEHNLNYMDLLMKLHY...VRSIYFF.DS......EAVQGLTIS
P.trichocarpa_757078#1_A                            ...R.ETCLVSVKDPVSSDIFQGCLSIVLCY.NK......AVEEDSGWLVAG
G.max_GM06MC00033_47170619@33#1_A                   ..EN.GAFQLNYMDLLVKLHY...IRPVFFF.TS......EAVQGLSIS
G.max_Glyma02g37870.1#1_A                           ..ED.GAYHLSNMDLLMKLHY...IRAVYFF.IN......DAAQGLSIY
P.trichocarpa_558994#1_A                            ...N.EDRKLTNMDLAFKLHY...VRGVSFF.SN......ETVQGLTIY
Aquilegia_sp_TC235512#1_A                           ...D.VFQNVSNMDLAMKLHY...LRGVYFF.EK......EAVEGLTIS
G.max_Glyma08g11560.1#1_A                           ...D.VFHNPGGLDLAMKLHY...LRVVYFF.DS......EAAQDLTIM
P.trichocarpa_549793#1_A                            ...D.VIHEPNGMDLAMKLPY...LKGVYFF.NS......QACQGLTIM
O.basilicum_TA1387_39350#1_A                        ...N.AEFDPGNLGLAMKLHY...LRGVYF.RS......EAFEGLTTL
B.napus_BN06MC34354_BNP3363_30@34198#1_A            ...N.KPRHLTAMDLAVKLHY...VRAVYFF.........KGTRDFTIF
A.thaliana_AT4G24510.1#1_A                          ...N.KPRQLTPMDLAMKLHY...VRAVYFF.........KGARDFTVA
A.thaliana_AT3G23840.1#1_A                          ....G.TTHEPTGLDLAMKLHY...LKAVYIY.SA......GTARDLTVM
A.thaliana_AT4G13840.1#1_A                          ....G.TTHEPTGLDLAMKLHY...LKAAYIY.SA......ETARDLTVR
O.sativa_LOC_Os04g52164.1#1_A                       ....ANYDLADADLAYKLHY...LRGAYYY.PA......GDAVRGITIK
T.aestivum_TC294447#1_A                             ....GSYELADADLAFRLHY...LRGVYYY.SA......GVTTM
A.thaliana_AT4G29250.1#1_A                          ....G.RLYQLSVLDHVMEPNH...IRLVYYY.RC......SKTREPGEITK
A.thaliana_AT2G19070.1#1_A                          ....G.KYFPLSVLDRYMENNH...IRMVYYY.QT......SREVELGKVTK
G.max_Glyma17g31040.1#1_A                           ....G.KFYPLSVLDHMMQLHN...VGLVYYY.RE......ALTTATSTDVVM
P.taeda_TA11048_3352#1_A                            SGKG.KAHALSALDSAMGSHT...VHVIYYY.KN......EEKWFESFDLLD
G.max_Glyma03g40670.1#1_A                           ....G.KTHALSPLDNAMERHT...VHVVVYL.RA......APGLDRE
Z.mays_ZM07MC26485_BFb0067H12@26407#1_A             ....H.SLY.LSNLDDHHFLRF.SIKYLYLF.QK......SISPL
A.thaliana_AT1G27620.1#1_B                          ....G.RFP.LAEWDQVGTITH...IPTLYFYDKP.....SESFQGNVVE
A.thaliana_AT2G19070.1#1_B                          ....G.RVS.LSELDQIGTITY...VPTIYFY.KP......SPNWLTPSNDVVN
P.trichocarpa_810871#1_B                            ....G.RVS.LSEWDQTGNVTH...VPIIYFY.RT......PSQESNNNSIAS
G.max_Glyma17g06860.1#1_B
```

FIGURE 8 (continued)

```
V.vinifera_GSVIVT00017-760C01#1_B      ...G.YRC.LSDSDQVRALTH...APIYFY.PP.....VNVSLESAIE
Aquilegia_sp_TC203397#1_B              ...V.KLW.LSECDQIKAYTH...APSFYIY.LP..QNLDNYSVSSPFE
G.max_Glyma08g42490.1#_B               ...D.PLW.LSNSDLIGFQGY...VPTLYVY.KA......KPNYSNNIE
G.max_GM06MC27564_sae62b11@26939#1_B   ...G.LLW.LSDIDQVARLRH...TPTIYIF.HA......KHNHDTLIE
A.tha_iana_AT5G48930.1#1_B             ...T.NLW.NSNVDLVIPRFH...TPSVYFY.RP......TGASNFFDPQ
P.trichocarpa_587193#1_B               ...R.GLW.NSNVDLVVPRFH...TPSVYFY.RP......TGAPNFFDAK
G.max_Glyma13g44830.1#_B               ...R.ALW.NSNVDLVVPNFH...TPSVYFY.RP......NGVSNFFDAK
P.vulgaris_TC13456#1_B                 ...K.VLW.ISNIDLLARDYH...SPTVYFY.KP......NGASNFFHSN
L.sativa_TC19194#1_B                   ...Q.RLW.NSNIDLIVGRIH...LLTIYFY.RP......NGSSDFFDSV
S.lycopersicum_TC20186:#1_B            ...K.RIW.SSNIDLIVGRIH...LLTVYFY.KP......NGSSNFFDNK
P.trichocarpa_784746#1_B               ...K.SIW.SSNIDLLVPIVH...VPTIYFY.KP......VNDSSFFNPQ
G.hirsutum_TC130878#1_B                ...E.RQW.ISNLDMVITTYH...VPLLFFY.KP......NGSSDFFKPQ
M.esculenta_TA8094_3983#1_B            ...NHHLW.LSNLDRTHERNN...IPTVYFY.KA......ADHPNTFEVK
M.truncatula_AC148816_-6.4#1_B         ...T.TLS.LSLCDQLKLPNH...GYQLYLF.TN...KNHSSSSLISSTN
A.tha_iana_AT5G41040.1#1_B             ...G.LYF.LSNLDQNIAVI...VRTIYCF.KS.....EERGNEEAVQ
A.tha_iana_AT5G63560.1#1_B             ...G.LHY.LSNLDQNIAII...VKTFYF.KS......NSRSNEESYE
B.napus_BN06MC25915_512674770@25820#1_B ...G.LYY.LSNLDQNIAVT...VKTFYF.KS......KSKTNQDSYN
G.max_Glyma05g38290.1#_B               ...G.LYYFLSNLDQNIAHP...VRTVYFYNKS.....ACRGNEEAAQ
P.trichocarpa_807676#1_B               ...G.FFF.LCNLDHMVTHS...VETVYFY.KA.....KKWGGSRDTLSD
P.patens_TC44371#1_B                   ...VPKVVPLSSSDVVPKVH...VEVIYAY.EA......SKGVSFDNVVQ
S.moe-lendorffii_431283#1_B            ...PCTLWLCNSQIQLLSENY...LKQVYYF.PE......AVDSSPGSFD
B.napus_TC72743#1_B                    ...DLRTLQLSIYDHFLPPIY...TVAYLFY.TK....DELMISPEHTSH
P.trichocarpa_768990#1_B               ...HLRSLKLSLLDQFMPVGH...IPLQLFY.PRNGNDTDHLAKATERSL
V.vinifera_GSVIVT00035-080C1#1_B       ...HLRSFKISLLDQLAPPFY...VPVILLF.SADDFDCE.AVDHVTICD
P.trifoliata_TA5574_37690#1_B          ...HQSSYKLSIIDQLTPNVY...FSILLY.SK......AGESTTKTSD
P.trichocarpa_579978#1_B               ...HLQSLKISSFDQHGQNHY...VPSFHFY.PANEEECG.VISNAEKSL
```

FIGURE 8 (continued)

```
                                                    101                                                              150
M.truncatula_CU137640_9.3#1_A                       DLKAPMFQL...LDSYSHVSGRVRIS.........E.SG.RPFIKCNDAGV
M.truncatula_transferase_CER2-like#1_A              DLKTPMFPL...LDLYSHVAGRVRIA.........K.SG.RPFIKCNDAGV
P.trichocarpa_757078#1_A                            WIKESLGRA..LQDQPMLSGRLRRV.........EDGNG.ELEMVSNDTGV
G.max_GM06MC00033_47170619@33#1_A                   DLKKPMFPL...LDPYYHVSGRVRRS.........E.SG.RPFVKCNDAGV
G.max_Glyma02g37870.1#1_A                           DLKKPMFPL...LDQVVQLSGRIRVS.........E.SG.RPFLKCNDAGV
P.trichocarpa_558994#1_A                            DLKEPMFSL...LALYPTASGRIRKS.........E.SG.RPFIKCNDGGV
Aquilegia_sp_TC235512#1_A                           KIKESMFYW...LDLYYISCSRVRRS.........ETTG.RPLIKCNDCGV
G.max_Glyma08g11560.1#1_A                           KIKDGMFTL...FNHYFITCGRFRRS.........D.SG.RPLIKCNDCGA
P.trichocarpa_549793#1_A                            QIKGSMFYW...LNDYYTVCGRFQRT.........E.AG.RPYMKCNDCGV
O.basilicum_TA1387_39350#1_A                        NVKEPLFSW...LNQFPMPCGRFRRS.........P.SG.RPFIKCNDCGV
B.napus_BN06MC34354_BNP3363_30@34198#1_A            YLKNITFPLLD.LPCYDHVTGRIRLL..DNKNPSA.QA.IPYIRCNDSGM
A.thaliana_AT4G24510.1#1_A                          DVKNTMFTLQSLLQSYHHVSGRIRMS..DNDNDTSAAA.IPYIRCNDSGI
A.thaliana_AT3G23840.1#1_A                          DVKAPLFSV...FYQIPCIIGRFRRH.........E.SG.RPYLKCNDCGT
A.thaliana_AT4G13840.1#1_A                          HLKEAMFML...FDQIAWTTGRFSRR.........D.SG.RPYIKCNDCGT
O.sativa_LOC_Os04g52164.1#1_A                       SLKDPMFPW...LDAYFPVAGRIRRAEGDDADAAA.AR.RPYIKCNDCGV
T.aestivum_TC294447#1_A                             VLKEPMFAW...LDAYYPLAGRVRRH..ADEADDA.SR.RPYVKCNDCGI
A.thaliana_AT4G29250.1#1_A                          KLRESLAYT..LNCYPIVTGRLVKEVDGMEENKDLSQ.RWMVKSNDAGV
G.max_Glyma17g31040.1#1_A                           KLRETLSEM..LTHFPIVSGRLVRD........DETG.HWKIKCNDAGV
P.taeda_TA11048_3352#1_A                            DLKVSLSRV...LSSYPAVCGRLQRR.........N.DG.NWEIRCSDAGV
G.max_Glyma03g40670.1#1_A                           PLRESLSEV...LTLYPTVTGRLGKR.........GVDG.GWEVKCNDAGV
Z.mays_ZM07MC26485_BFb0067H12@26407#1_A             QLKESLSEV...LSLYPAMTGRLTRG.EGSADAEPAHR.GWVVKCNDAGV
A.thaliana_AT1G27620.1#1_B                          TLKDSLSRV...IVDYYPFAGRIRVS.........D.EGSKLEVDCNGEGA
A.thaliana_AT2G19070.1#1_B                          ILKTSLSRV...LVHFYPMAGRLRWL.........P.RG.RFELNCNAEGV
P.trichocarpa_810871#1_B                            DLKDSLRDV...LVPFYLLAGRLHWI.........G.RG.RLELECNAMGV
G.max_Glyma17g06860.1#1_B                           TLKDSLSRV...LVPFYPLAGRLHWI.........N.NG.RLELDCNAMGV
```

FIGURE 8 (continued)

| | | | |
|---|---|---|---|
| V.vinifera_GSVIVT00017176001#1_B | ILRHSLSEA...LVIFYPLAGWLHWI.........G.GG.RLVLECNALGA |
| Aquilegia_sp_TC20397#1_B | TLKSSLSHV...LVPYYPLAGRLNWI.........G.GG.RFELNCNGMGA |
| G.max_Glyma08g42490.1#1_B | RLRNSLSKL...LVYYYPVAGRLSLT.........K.SG.RMEVDCNAKGV |
| G.max_GM06MC27564_sae62b11@26939#1_B | RMRNSLSKI...LVHYYPIAGRLRRI.........EGSG.RLELDCNAKGV |
| A.thaliana_AT5G48930.1#1_B | VMKEALSKA...LVPFYPMAGRLKRD.........D.DG.RIEIDCNGAGV |
| P.trichocarpa_587193#1_B | VLKGALSKA...LVPFYPMAGRLRRD.........E.DG.RIEINCNAEGV |
| G.max_Glyma13g44830.1#1_B | VMKEALSKV...LVPFYPMAARLRRD.........D.DG.RVEIYCDAQGV |
| P.vulgaris_TC13456#1_B | TLKEALSKT...LVLFYPMAARLRHG.........D.DH.RVEIYCDGQGA |
| L.sativa_TC19194#1_B | VLKQALSDV...LCSFFPMAGRLGTD.........G.DG.RVEINCNGEGV |
| S.lycopersicum_TC201861#1_B | VIKEALSNV...LVSFYPMAGRLGRD.........E.QG.RIEVNCNGEGV |
| P.trichocarpa_784746#1_B | VLKEALSKA...LVPFYHMAGRLEKD.........E.NG.RMSILCNSKGV |
| G.hirsutum_TC130878#1_B | VLQEALSKT...LVQFYPMAGRLGHD.........E.NG.RLEIVCNAEGV |
| M.esculenta_TA8094_3983#1_B | VLKDALSKV...LVLFYPAAGRLGRD.........N.KG.RLEIVCNNEGA |
| M.truncatula_AC148816_16.4#1_B | ILITSLSKT...LTHYYPFAGRLSWI.........KPQNHLLQLHCNNKGV |
| A.thaliana_AT5G41040.1#1_B | VIKKALSQV...LVHYYPLAGRLTIS.........P.EG.KLTVDCTEEGV |
| A.thaliana_AT5G63560.1#1_B | VIKKSLSEV...LVHYYPAAGRLTIS.........P.EG.KIAVDCTGEGV |
| B.napus_BN06MC25915_51267477@25820#1_B | VIKDALSKV...IVHYYPVAGRLTIS.........P.EG.KIAVNCTGEGA |
| G.max_Glyma05g38290.1#1_B | VIKDALSKV...LVHYYPMAGRLAIS.........S.EG.KLIIECTGEGV |
| P.trichocarpa_807676#1_B | TFKQSLAKI...LVHYYPLAGRLRLG.........S.DG.KYNVECTNEGV |
| P.patens_TC44371#1_B | VLEEALGRV...LTEYREWAGRLVIN.........E.TG.RPAIELNDDGV |
| S.moellendorffii_431283#1_B | RL......V...LVPYYPIAGRPRIA.........G.LD.RPVLECNNQGV |
| B.napus_TC72743#1_B | KLKTSLSET...LTKFYPLAGRIN............GVTVDCNDEGA |
| P.trichocarpa_768990#1_B | LLKTSLSEA...LTHFYPFAGRLKD............NSSIECDDHGA |
| V.vinifera_GSVIVT00035108001#1_B | LLKRSLSQT...LSRFYPLAGKLKG............NDSVDCSDDGA |
| P.trifoliata_TA5574_37690#1_B | HLKKSLSNT...VTHYYPLAGQLKYD............QLIVDCNDQGV |
| P.trichocarpa_579978#1_B | RLQESLSEV...LTLYYPFAGRYSSD............EPLIECNDKGA |

```
                                              151                                                          200
M.truncatula_CU137640_9.3#1_A                 RIAES.HCEK.TLREWL.DEK....EYS..VDELVYD.HVLGPD..LAFS
M.truncatula_transferase_CER2-like#1_A        RIAES.QCDK.TLREWL.DEN....EYS..VDELVHD.HVLGPD..LAFS
P.trichocarpa_757078#1_A                      RLVEA.KITM.TLQEFL.GLE....ENEKAEAELVSWMDIDEQN..PQFS
G.max_GM06MC00033_47170619@33#1_A             RIAES.HCDR.TLEEWF.REN....GNG.AVEGLVHD.HVLGPD..LAFS
G.max_Glyma02g37870.1#1_A                     RIAEY.HHDH.TLGEWF.QKN....GCS..LQGIVHD.HVLGPD..LGFS
P.trichocarpa_558994#1_A                      RIVEA.HCDK.TIEEWL.KIN....DHKPLDDYLVYD.QVLGPD..LGFS
Aquilegia_sp_TC235512#1_A                     RIIEA.KCKM.NMDDFL.QLK....DCS.LQNRLVYN.QVLGPE..LTFS
G.max_Glyma08g11560.1#1_A                     RFIEA.KCNK.TLDEWL.AMK....DWP.LYKLLVSH.QVIGPE..LSFS
P.trichocarpa_549793#1_A                      RIVEA.RCSK.TVDEWL.ETR....DCS.LDNLLIYH.SPIGPE..LFFS
O.basilicum_TA1387_39350#1_A                  RFIHA.KCDH.TLDHWL.HIK....DSL.LEALLCQN.HVLGPQ..LPYS
B.napus_BN06MC34354_BNP3363_30@34198#1_A      RIVEA.KVEGFTVQEWL.DLD....DRSIDHRFLVYD.HVLGPD..LLYS
A.thaliana_AT4G24510.1#1_A                    RVVEA.NVEEFTVEKWL.ELD....DRSIDHRFLVYD.HVLGPD..LTFS
A.thaliana_AT3G23840.1#1_A                    RFVES.HCDL.TVEEWL.RVP....DRS.VDESLVYH.QPVGPD..LAFS
A.thaliana_AT4G13840.1#1_A                    RFVEG.QCNL.TVEEWL.SKP....DRS.VDEFLVYH.HPIGPE..LTFS
O.sativa_LOC_Os04g52164.1#1_A                 RIVEA.RCDR.ALDDWL.RDE....SPD.RLRHLCYD.KVLGPE..LFFS
T.aestivum_TC294447#1_A                       RIVEA.QCDR.ALDDLL.RDD....AVD.RVKQLCYH.HVLGPE..LSFS
A.thaliana_AT4G29250.1#1_A                    RMVEA.RATG.SVKEWL.RSV....NRE.EELKLVHW.EDMYHL..QYYW
G.max_Glyma17g31040.1#1_A                     RVVEA.KAKG.SVGGWL.ANL....DRE.KELQLVHW.EDMFHK..PYYW
P.taeda_TA11048_3352#1_A                      RVLEA.KVDM.TLEKWF.EVA....DRD.SELKLCYW.ETVGQD..PYIS
G.max_Glyma03g40670.1#1_A                     RVIKA.SVDA.TLDQWL.KSA....SGS.EENLLVAW.DHMPDD..PTTW
Z.mays_ZM07MC26485_BFb0067H12@26407#1_A       RMVDA.RAAV.TLDEWL.ATA....TGD.EEMDLLYY.EPMGAE..PYIW
A.thaliana_AT1G27620.1#1_B                    VFAEA.FMDI.TCQDFV.QLSPK..PNK.SWRKLLFK..VQAQS..FLDI
A.thaliana_AT2G19070.1#1_B                    EFIEA.ESEG.KLSDFK.DFS....PTP.EFENLMPQ.VNYKNP..IETI
P.trichocarpa_810871#1_B                      MFTEA.ESES.KLEDLG.DFL....PSS.EYKYLIPN.VDYTVP..IHDL
G.max_Glyma17g06860.1#1_B                     QFIEA.ESSS.SFEDLGDDFS....PSS.EYNYLVPT.VDYTLP..IHGL
```

```
V.vinifera_GSVIVT00017176001#1_B       LLIAV.ESDA.KIDDFG.DFG....PTQ.EIRALIPS.VDYDKP..IHEL
Aquilegia_sp_TC20397#1_B                EIVEA.ESQF.EIQDLG.DFR....PTP.ETKKLLPP.VDYTRE..ISEL
G.max_Glyma08g42490.1#1_B               TLIEA.ETTN.TFADYG.DFTT...PSE.STDELVPK.IDSTQP..IEET
G.max_GM06MC27564_sae62b11@26939#1_B    VLLEA.ESTK.TLDDYG.DFL....RE.SIKDLVPT.VDYTSP..IEEL
A.thaliana_AT5G48930.1#1_B              LFVVA.DTPS.VIDDEG.DFA....PTL.NLRQLIPE.VDHSAG..IHSF
P.trichocarpa_587193#1_B                LFVEA.ETTS.VIDDFA.DFA....PTL.ELKQLIPT.VDYSGG..ISTY
G.max_Glyma13g44830.1#1_B               LFVEA.ETTA.AIEDFG.DFS....PTL.ELRQLIPS.VDYSAG..IHSY
P.vulgaris_TC13456#1_B                  LFVEA.HAAV.SMDQFT.......HNF.HNRNLIPA.VDYSAG..IETY
L.sativa_TC19194#1_B                    LFVEA.EADC.KIDDFG.EIT....PSP.ELRRLAPT.VDYSGD..ISSY
S.lycopersicum_TC201861#1_B             LFVEA.ESDS.CVDDFG.DFT....PSL.ELRKLIPS.VETSGD..ISTF
P.trichocarpa_784746#1_B                LFVEA.ETRS.TIDELG.DFT....PHF.EMLQFIPE.VDRSN...IFSY
G.hirsutum_TC130878#1_B                 LWIEA.ETTS.AMDDLD.DFT....PCS.KLRKLVPT.ADYSGD..ISSY
M.esculenta_TA8094_3983#1_B             LFIEA.ETDY.ELDELG.DLM....LT..EVSQLIPS.IDYSQG..ISSF
M.truncatula_AC148816_16.4#1_B          QFLEA.TCDI.TLKDFG.SFD....STH.VVQKIVPK.INYDVP..VEDL
A.thaliana_AT5G41040.1#1_B              VFVEA.EANC.KMDEIG.DITK..PDPE.TLGKLVYD.VVDAKN..ILEI
A.thaliana_AT5G63560.1#1_B              VVVEA.EANC.GIEKIK.KAISEIDQPE.TLEKLVYD.VPGARN..ILEI
B.napus_BN06MC25915_51267477@25820#1_B  VLVEA.ETNC.GIEMIK.EAISE.NRME.MLEELVYD.IPGARN..ILEI
G.max_Glyma05g38290.1#1_B               VFVEAEEANC.VIKDLG.DLTKQ.PDLE.TLGKLVYD.IPGATN..MLQI
P.trichocarpa_807676#1_B                LFVEA.RANC.NMDQVD.VKVI-DDHSE.TAGKLVYG.SPDPEN..ILEN
P.patens_TC44371#1_B                    VFVEA.VADG.CLQDVT.PFD....PSP.LLLSMVPP........SRGV
S.moellendorffii_431283#1_B             EFVVA.FANA.SFHDWG.DSM...KHCSIEHELNQA.QTEITD..HENF
B.napus_TC72743#1_B                     VFVDA.RVDNCSLSGFL.ASP....DLN.ALQQLIPLDAVQNPYEAASTW
P.trichocarpa_768990#1_B                EYIEA.RIHC.ILSDIL.KKP....DTE.VLKQLMPA.AVSEPA..TARD
V.vinifera_GSVIVT00035108001#1_B        VFMEA.RANV.ELSEIL.RDP....EID.LLQKLLPC.EPYSVGSESSDR
P.trifoliata_TA5574_37690#1_B           PFIEA.HVAN.DMRQLF.KIP....NID.VLEQLLPF.KPHEGF..DSDR
P.trichocarpa_579978#1_B                EYLEA.QVAG.SLSQLL.SDE....ELE...TQLQNHFVPPMFD..PISS
```

FIGURE 8 (continued)

```
                                                                                         250
M.truncatula_CU137640_9.3#1_A              201
M.truncatula_transferase_CER2-like#1_A     P.LVFVKFTFFKCG..GLSVGLSWAHILGDAFSARNFITKWSHTLAGQA.
P.trichocarpa_757078#1_A                   P.LVFVKFTSFKCG..GLSVGLSWAHILGDAFSAFNFITKWSHILAGQS.
G.max_GM06MC00033_47170619@33#1_A          P.LLYVQVTNFQCG..GYSIGISSSLLLADHLIMDNFLPRWSGIQKKLLL
G.max_Glyma02g37870.1#1_A                  P.LVFVKFTWFKCG..GLSVGLSWAHVLGDAFSAFNFLSKWSQILAGQA.
P.trichocarpa_558994#1_A                   P.LVFVKFTWFKCG..GLSLGLSWSHVLGDAFSAFSFITKWSQILAGHA.
Aquilegia_sp_TC23512#1_A                   P.LVFVQFTWFKCG..GMSVGLSWAHVLGDPFSASTFINTWGKIMQGHV.
G.max_Glyma08g11560.1#1_A                  P.LAMIQLTWFKCG..GMSVGLRWAHVLGDAFSATEYINIWGQVLAGHL.
P.trichocarpa_549793#1_A                   P.PVLFQVTKFKCG..GISLGLSWAHVLGDPLSASEFINSWGLILKNMG.
O.basilicum_TA1387_39350#1_A               P.SLYMQVTKFKCG..GMSLGISWAHIIGDVYSASECLNSWGQFLAGLK.
B.napus_BN06MC34354_BNP3363_30@34198#1_A   P.LLYLQMTVFKCG..GVGMGLSWAHVVGDAFSAAKIMNMLGRVISGFK.
A.thaliana_AT4G24510.1#1_A                 P.LVFLQITQFKCG..GLSVGLSWAHVLGDVFSASTFMKTLGQLVSGHA.
A.thaliana_AT3G23840.1#1_A                 P.LLYIQMTRFSCG..GLCIGLSWAHILGDVFSASTFMKTLGQLVSGHA.
A.thaliana_AT4G13840.1#1_A                 P.LLYVQMTRFKCG..GLALGLSWAHIMGDPFSLSHFFNLWAQAFAGGK.
O.sativa_LOC_Os04g52164.1#1_A              P.LLIYQMTRFKCG..GLGLGLSWANIIGDAFSLFYAFNLWAKAITGEK.
T.aestivum_TC294447#1_A                    P.LLYIQVTSFKCG..GMALGFSWAHLIGDVASATACFNTWAQILSGKK.
A.thaliana_AT4G29250.1#1_A                 P.LLFVQVTNFKCG..AMALGFSWAHLMGDVASATTCFNRWAQILGGKK.
G.max_Glyma17g31040.1#1_A                  S.TFCVQVTEFESG..GLAIGLSCSHLLADPVCAMMFIRAWADLTLSRS.
P.taeda_TA11048_3352#1_A                   S.TFYVQLTEFEEG..GLAIGLSCFHLLVDSTCATLFMKAWADISMVNK.
G.max_Glyma03g40670.1#1_A                  S.LFCVQFTEFEGG..GLAIGLSCGHMLADPSCATLIMKAWGETHRRAQ.
Z.mays_ZM07MC26485_BFb0067H12@26407#1_A    S.PFRIQVNRFEGG..GVAIGISCSHMVADLTFLASFFKSWTEVHRHLA.
A.thaliana_AT1G27620.1#1_B                 S.PFYVQLTEFTDK..SYALGLSCIHIHNDPTAAALFHAWAAAHRRTT.
A.thaliana_AT2G19070.1#1_B                 P.PLVIQVTYLRCG..GMILCTAINHCLCDGIGTSQFLHAWAHATTSQA.
P.trichocarpa_810871#1_B                   P.LFLAQVTKFKCG..GISLSVNVSHAIVDGQSALHLISEWGRLARGE..
G.max_Glyma17g06860.1#1_B                  P.LLLVQLTKFQCG..GISLSLTISHAVVDGQSALHFMSEWARIARGE..
                                           P.LVLIQLTNFKCG..GVSIGITLSHAVVDGPSASHFISEWARLARGE..
```

FIGURE 8 (continued)

```
V.vinifera_GSVIVT00017176001_#1_B      P.LLLVQVTKFSCG..GISLGLGAIHIMTDGLSASHFISEWAKIARGE...
Aquilegia_sp_TC20397#1_B                P.LLLVQLTRFKCG..GISIGVAISHIVADGKGALGFISSWANYARGEY.
G.max_Glyma08g42490.1#1_B               P.ILVVQLTRFRGGDEGLAVGFGMFHSLTDATGIIHFMNRWAKLARGEEL
G.max_GM06MC27564_sae62b11@26939#1_B    P.SLLVQVTFHGG..KSFAIGVALCHILCDGVGAIQFINSWAKLARGDTL
A.thaliana_AT5G48930.1#1_B              P.LLIVLQVTFFKCG..GASLGVGMQHHAADGFSGLHFINTWSDMARGL.
P.trichocarpa_587193#1_B                P.LLIVLQVTYFKCG..GVSLGVGMQHHAADGFSGLHFVNTWSDMARGL.
G.max_Glyma13g44830.1#1_B               P.LLIVLQVTYFKCG..GVSLGVGMQHIVADGASGLHFINAWSDVARGL.
P.vulgaris_TC13456#1_B                  P.LVVLQVTHFRCG..GVSLGVGIEHRLADGASGLHFINSWSDVARGI..
L.sativa_TC19194#1_B                    P.LVITQVTHFRCG..GVSLGCGVHHTLSDGFSSLHFINTWADIARGL..
S.lycopersicum_TC201861#1_B             P.LVIFQITRFKCG..GVALGGGVEHTLSDGLSSIHFINTWSDIARGL..
P.trichocarpa_784746#1_B                P.LLLLQATLFKCG..GVCLGVGLHHILGDGTSAIHFINSWSEIARGL..
G.hirsutum_TC130878#1_B                 P.LIMAQVTTLKCG..GVCLGIATHHTLTDGTTTLHFINSWSEMARGLP.
M.esculenta_TA8094_3983#1_B             P.LFTAQVTKFRKCG..GLSLGLRNHHTIADGFAALHLVNTWCDVARGL..
M.truncatula_AC148816_16.4#1_B          P.LLIVVQFTTKFPCG..SLTLGLSMGRSVLDGSSAGSFISSWAKLAKGESL
A.thaliana_AT5G41040.1#1_B              P.PVTAQVTKFRKCG..GFVLGLCMNHICMFDGIGAMEFVNSWGQVARGL.
A.thaliana_AT5G63560.1#1_B              P.PVVVQVTNFKCG..GFVLGLGMNHINMFDGIAAMEFLNSWAETARGL..
B.napus_BN06MC25915_512674770@25820#1_B P.PLLIQVTKFRKCG..GFILGLGMSHNMFDGVAAAEFLNSWCETAKGL..
G.max_Glyma05g38290.1#1_B               P.LMTAQVTRFRCG..GFVLGVNVNHCMVDGISAMQFVNAWGETARGM...
P.trichocarpa_807676#1_B                PELLLVQVTKYRCG..GFALGLSISHLIADGLSAMEFIKSWSETARGM..
P.patens_TC44371#1_B                    P.QL..KVTKFRCG..GLTLGVARIHQVADGTSASQFMNAWASACKGIP..
S.moellendorffii_431283#1_B             P.LLLLVKATYFQCG..GIALGLVTTHIVTDGSSIFAFFKAWSDIHQGLP.
B.napus_TC72743#1_B                     S.QLIVQASFFDCG..GMAIGVCITHKIADAASMSTFIRTWSAEARGEAG
P.trichocarpa_768990#1_B                A.ITAIQATIFECG..GLAIGVNLSHKVADAATLTSFIKCWAATARRSST
V.vinifera_GSVIVT00035108001_#1_B       S.NLTVQVNYFGCG..GIGIGVCMSHKVADGATLATFLTAWSATAMGT..
P.trifoliata_TA5574_37690#1_B           P.PLVVQFNRFECG..GMAIGLCFRHKVIDATTAAFFVKNWGVIARGAG.
P.trichocarpa_579978#1_B                P.PLVVQFNRFECG..GIAIGVSMTHKMVDAFSAFGFITAWATACRIGI.
```

FIGURE 8 (continued)

| | 251 | | | 300 |
|---|---|---|---|---|
| M.truncatula_CU137640_9.3#1_A | P..PKSLHM.PNLTKPQFL.....SNSVYDN..P..ISIKRAT..TIEE |
| M.truncatula_transferase_CER2-like#1_A | .Q..PKSLHI.PNLVKPQFL.....SNFVFDN..P..ISIKNEN..VVGE |
| P.trichocarpa_757078#1_A | NNNALEKPIFYLPNLRNTSL................SPSNTTR..STPS |
| G.max_GM06MC00033_47170619@33#1_A | .P..PKSLHV.SSFPEPKIS.....HNSIVDD.PP..VSIKKTN..ILGE |
| G.max_Glyma02g37870.1#1_A | .P..PKILPMSPTLKEIQTPHNNNSVNANNGN..H..FSVKTAT..TIEE |
| P.trichocarpa_588994#1_A | .P..SRSPHV.PNTKKSKYP.....LSTTRRK..P..FSLKRVD..PVGD |
| Aquilegia_sp_TC235512#1_A | .Q..PSRSIKDPKFQFKAQA.....QVQNTEKSFIP..LSVKRVD..PVGD |
| G.max_Glyma08g11560.1#1_A | ...LKMLFNIPRSIPTPGQ.....PGPEKD..P..VSAKRID..PVGD |
| P.trichocarpa_549793#1_A | .SYGPLKLTKSPTGLEDSKS.....PSVGTQE..P..VSLKQVD..PVGD |
| O.basilicum_TA1387_39350#1_A | .P..ERPIDLTQTLNELRIP.....DCVPNITED..P..VSVRRVD..PVGD |
| B.napus_BN06MC34354_BNP3363_30@34198#1_A | ....PSKPVYPKKPELTPHA.....NGQVDDDGQA..ISIKKVE..SVGE |
| A.thaliana_AT4G24510.1#1_A | ....PTKPVYPKTPELTSHA........RNDGEA..ISIEKID..SVGE |
| A.thaliana_AT3G23840.1#1_A | ...IYCPKT.SVTERDFQN.....PTSTFKK..P..DSVKQVD..LVGD |
| A.thaliana_AT4G13840.1#1_A | ...IYAPTTPSIGERRFQS.....PNPTVKD..P..VSIKRVE..PVGD |
| O.sativa_LOC_Os04g52164.1#1_A | ...PAGTVLEPANKPLDRA.....PAAAAAAP..P..RSVKPVG..PIED |
| T.aestivum_TC294447#1_A | ...PVAVTMSPINEPRERN........RTPSA..VAPRSVK..PVGP |
| A.thaliana_AT4G29250.1#1_A | .M..MAPPLFHPLPPRRFSN.....QRLISNNQLLS..HYIKSCS..LTAS |
| G.max_Glyma17g31040.1#1_A | .M..ITPPLFHHLPPRRPPN.....RNPNHHLHM..ELIHHYK..SLIE |
| P.taeda_TA11048_3352#1_A | .V..LHPPFFHPPGLKARPN.........KCEVT..TATKYYE..STFK |
| G.max_Glyma03g40670.1#1_A | .I..THPPFVAPLPNHADDD.........AESLP..RHAKTHS..P.... |
| Z.mays_ZM07MC26485_BFb0067H12@26407#1_A | .S..TYPPFLHPPALAVSPT.....SPPPAPPLLA..EKASAAS..PTST |
| A.thaliana_AT1G27620.1#1_B | HL..PTRPFHSRHVLDPRNP.....PRVTHSHPGF..TRTTTVDKSSTFD |
| A.thaliana_AT2G19070.1#1_B | PL..ETVPFLDRKIIWAGEPLPPFVSPPKFDHKEF..DQPPFLI..GETD |
| P.trichocarpa_810871#1_B | PL..GVVPFLDRKVLRARDP...PIASQFHHAEF..DLPPLLL..GQLN |
| G.max_Glyma17g06860.1#1_B | PL..QTVPFHDRKVLHAGDP.PSVPLARCHSHTEF..DEPPLLL..GKTD |

FIGURE 8 (continued)

```
V.vinifera_GSVIVT00017176001#1_B        QP..NSSPFLDRSILLAPEH....LSAPVFDHPEY..SPQPLLI..GKQD
Aquilegia_sp_TC20397#1_B                 KL..VVEPYHDRTLFYKGDP....LANPRFDHHEL..KTSPTLI..GHED
G.max_Glyma08g42490.1#1_B                NP..NEIPFLDRTILQLFSS....SSQHVDQPEW..KPITQAQ..GV..
G.max_GM06MC27564_sae62b11@26939#1_B     EP..HEMPFLDRTVLKFPHP....LSPPRFDHLEF..KPLPLIL..GRSD
A.thaliana_AT5G48930.1#1_B               DL..TIPPFIDRTLLRARDP....PQPAFHHVEY..QPAPSMK..IPLD
P.trichocarpa_587193#1_B                 DL..TIPPFIDRTLLRARDP....PQPVFHHVEY..QPPPSMK..TVLE
G.max_Glyma13g44830.1#1_B                DI..SLPPFIDRTLLRARDP....PLPVFDHIEY..KPPPATKKTTPLQ
P.vulgaris_TC13456#1_B                   PI..SVPPFIDRNLLRARDQ....PQPAFPHHEY..QLSPPIT..TT..
L.sativa_TC19194#1_B                     PV..AIPPFNDRSLLRARDP....PTPMFDHVEY..HPPPSLI..TPPE
S.lycopersicum_TC201861#1_B              SV..AVPFFIDRTLLRARDP....PTSSFEHVEY..HPPPTLN..SSK.
P.trichocarpa_784746#1_B                 SV..TIPPFIDRTLLDARVP....PFPAMHHVEY..DPPPTLN..THNS
G.hirsutum_TC130878#1_B                  QI..SMPPVIDRTLLRARVP....PIPRFHHLEY..DRPPSLY..TSTS
M.esculenta_TA8094_3983#1_B              SI..TTPPFIDRTILRCRDP....PTPKFKHVEY..DKPLSMS..SDAQ
M.truncatula_AC148816_16.4#1_B           DS..SLIPFLDKTLLDSKIL....HLPPRFHHHEF..SPPPLWE..NSSN
A.thaliana_AT5G41040.1#1_B               PL..TTPPFSDRTILNARNP....PKIENLHQEF..EEIEDKS..NINS
A.thaliana_AT5G63560.1#1_B               PL..SVPPFLDRTLLRPRTP....PKIEFPHNEF..EDLEDIS..GTGK
B.napus_BN06MC25915_512674777@25820#1_B  PL..SLPPFLDRAILQPRKP....PKIEFPHNEF..DEIEDIS..GTGR
G.max_Glyma05g38290.1#1_B                DL..SISPVLDRTILRTRNP....PKIEYPHHEF..DEIEDVS..NVTK
P.trichocarpa_807676#1_B                 PL..TTKPVLDRSILRSRQP....PKIDFHFDQYAPAETSNVS..NISN
P.patens_TC44371#1_B                     ...PSPILHDRAALMPRDQ....PMPTFDHIEY..VMPLPKP..VAKD
S.moellendorffii_431283#1_B              PP..NPPPSFDSSILRARDP....PSIKMPIRDYVAVAPSLAQ..DHTG
B.napus_TC72743#1_B                      NT..VMDPKFSAANFYPPAN..........DTYK..LPVDEKA.....
P.trichocarpa_768990#1_B                 EV..VISPVFMGASIFPQMD..........LPISM..LPVDL......
V.vinifera_GSVIVT00035108001#1_B         DD..GITPFLDSASLFPPRD..........INT..VLSSGVI......
P.trifoliata_TA5574_37690#1_B            .E..IKDVIIDHASLFPARD..........LSCLA..KSVDEEF....
P.trichocarpa_579978#1_B                 DK..ACPPSFELGSIFPPRD..........AFRIE..NWERKAT....
```

FIGURE 8 (continued)

```
                                                       301                                                              350
M.truncatula_CU137640_9.3#1_A                          YWLAA....TDSYVATHTFHITSK.QLHHLLTTSTSTNIN......INTKT
M.truncatula_transferase_CER2-like#1_A                 YWLAA....NDCYVPSHTFHITSS.QLHHLVKTTKSI........TNTDT
P.trichocarpa_757078#1_A                               KQ......SDSEIEGVQNELCKR.AVSHCIQEA..........EHKLG
G.max_GM06MC00033_47170619@33#1_A                      YWLAT....NYHDVATHSFHITSK.QLHHLVTATFNQTNDNTN.KAKTT
G.max_Glyma02g37870.1#1_A                              LWLAT....NGIKMVTHTFHVTAK.QLNRLVSSTFFSCDQN...KATKT
G.max_Glyma02g37870.1#1_A                              SWLST....NNCKMETHSLHVTAE.QLDDILSDNIRGQK.....QPTEL
P.trichocarpa_558994#1_A                               YWITP....NNCKMGTLSLEIRAD.QLTKLQSDIFDQS......QNGKN
Aquilegia_sp_TC23512#1_A                               HWIPA....NNKKMETFSFHLTSS.QLNYLQAQIWGT.......SLDQT
G.max_Glyma08g11560.1#1_A                              LWVTA....NNCKMETFSFHLSAS.QVSQLHSRIWGPS......GIAKI
P.trichocarpa_549793#1_A                               SWVYA....TTCKMETFSFNVSPA.KLSHLRSKLAK........HGVDS
O.basilicum_TA1387_39350#1_A                           YWLLS....NKCKMGRFNIKFSLE.QIDRLMAKY..........QSS
B.napus_BN06MC34354_BNP3363_30@34198#1_A               YWLLT....NKCKMGRHIFNFSLN.HIDSLMAKYTT........RDQPF
A.thaliana_AT4G24510.1#1_A                             LWVAP....NNSKMTTFSFNLITVN.DLKTHFPVN..........GD
A.thaliana_AT3G23840.1#1_A                             LWVTP....NDKKLANYCFNLSVADQISPHFPAK..........GDDSI
A.thaliana_AT4G13840.1#1_A                             HWLVP....AGRAMAWYSFRVTEP.ALKKLQSAA..........GRHAA
O.sativa_LOC_Os04g52164.1#1_A                          HPRPL....AGPRRRHDVLLLPR.YRNDAREAA...........AAGAS
T.aestivum_TC294447#1_A                                PSNM.....TEDHMVTVTFLFPDP.LVRAGE..............NEPRI
A.thaliana_AT4G29250.1#1_A                             KPNST....KETMYTTISMGFSNP.MVQACMSMAQ..........PNGPI
G.max_Glyma17g31040.1#1_A                              RELATSCDQGDAGYKTTIFKFSDE.MVQQCVSEVQGGDH......KYEPV
P.taeda_TA11048_3352#1_A                               ........RNMATATFKFSSS.IINRCLSKVHG..........TCPNA
G.max_Glyma03g40670.1#1_A                              D......AAAAMSSATHFPAS.AVRALLSSLE............PGT
Z.mays_ZM07MC26485_BFb0067H12@26407#1_A                ISKYL...QSQPLAPATLTFNQS.HLLRLKKTCA..........PSLKC
A.thaliana_AT1G27620.1#1_B                             NVEE....RKKKTIVVMLPLSTS.QLQKLRSKANGSKHSD....PAKGF
A.thaliana_AT2G19070.1#1_B                             NAEE....RKKKATVAMLRLTKV.QVENLKNVANEERISTD...SGRGY
P.trichocarpa_810871#1_B                               NTEE....RKKKTAMVILKLSKT.QVETLKKTANYGGY......GNDSY
G.max_Glyma17g06860.1#1_B
```

FIGURE 8 (continued)

```
V.vinifera_GSVIVT00017176001#1_B       HMEE....RKRESATLTKLSKD.QVEKLKDKANKDRSASN...NKRPY
Aquilegia_sp_TC20397#1_B                AEEE....RKKECINTMKLSKT.QVNKLRELANEGRDA....TSRQY
G.max_Glyma08g42490.1#1_B               ........EQKQRSCSLLKLTSS.QVERLKKTNDESPKEL..GVRPY
G.max_GM06MC27564_sae62b11@26939#1_B    NTVE....KNKKVDATLLKITPE.QVGKLKKKANDDSTKE..GSRPY
A.thaliana_AT5G48930.1#1_B              PSKS....GPENTTVSIFKLTRD.QLVALKAKSKEDG....NTVSY
P.trichocarpa_587193#1_B                TS......KPESTAVSIFKLSRD.QLSTLKAKAKEDG....NNISY
G.max_Glyma13g44830.1#1_B               PSKPLGS..DSTAVAVSTFKLTRD.QLSTLKGKSREDG...NTISY
P.vulgaris_TC13456#1_B                  ........TNTTAVASIFKLSRE.QLNILKGKSKEDG....NTVNF
L.sativa_TC19194#1_B                    N.......HKSPASTTILRLTLD.QINDLKSKGKGDG....SVYH
S.lycopersicum_TC201861#1_B             ........NRESSTTMLKFSSE.QLGLLKSKSKNEG......
P.trichocarpa_784746#1_B                GDQTLEIQSNPKPTCAKILTITFD.QLRTLKNKSRKGVVD..GTINY
G.hirsutum_TC130878#1_B                 LGPN....NHKPSTVYFKITQN.QLNTLKAKSWEHG.....NKTNY
M.esculenta_TA8094_3983#1_B             IL......TSQQNCIEIFKITPQ.QLQTLKNKVKNVD....GKTKY
M.truncatula_AC148816_16.4#1_B          NSTHLS..KNPLFATTMLKFTKK.QVEKLKNKANNNEN...KVRGY
A.thaliana_AT5G41040.1#1_B              LY......TKEPTLYRSFCFDPE.KIKKLKLQATENSESL.LGNSC
A.thaliana_AT5G63560.1#1_B              LY......SDEKIVYKSFLFGPE.KLERLKIMAET.......RS
B.napus_BN06MC25915_512674770@25820#1_B LY......DEEKIVYKSFLFEPQ.KLEKLKTMTNEEDSN..SNNKV
G.max_Glyma05g38290.1#1_B               VY......EEEILYESFCFDPD.KLELLKKMATSEDG....VVKKC
P.trichocarpa_807676#1_B                PF......QGEQILTKCFLFDSN.KLAILKSMAMEDG....TIKSC
P.patens_TC44371#1_B                    TF......NNRPLARKKIRFSFD.MVQKIKSKAVKENDER..GFPTY
S.moellendorffii_431283#1_B             KSGED...ISPKYHVREFHMSEL.QLSHLRHEIASGPFS...YGSFP
B.napus_TC72743#1_B                     ........NKRSSITKRFVFGAS.KLEELRTKATSPE.....SADIP
P.trichocarpa_768990#1_B                ........IQGESVMKRFVFEAP.KITALKAKAISA......SVPDP
V.vinifera_GSVIVT00035108001#1_B        ........SHGKTLTRRFLFDAA.SLARLQSKASN........S
P.trifoliata_TA5574_37690#1_B           ........LKPESETKRFVFDGP.TIASLQETFTS........FERRP
P.trichocarpa_579978#1_B                ........ATNKIVTKRFVFDAV.AISNLKAAVSASARNNSSELPKQQI
```

```
                                                  351                                                              400
M.truncatula_CU137640_9.3#1_A                     KYFEIISAMIWKCIGQIRG..N.FG....PRV..V..TICTTN..ISNRA
M.truncatula_transferase_CER2-like#1_A            KYFEIISATIWKCIAQIRG..D.IG....PKV..V..TICSKNKNTSKCA
P.trichocarpa_757078#1_A                          SEMSSEFSLFVKESPKVKR..VENC.................KKNEL
G.max_GM06MC00033_47170619@33#1_A                 TYFEIISALLWKCIANIRG..QKIG....PNV..V..TICTSE..SNRA
G.max_Glyma02g37870.1#1_A                         SYFEILSALVWKHIAGMRE..D.TE....PKV..V..TICTRG....MA
P.trichocarpa_558994#1_A                          SHFQVLSAIWKSLSKVRE..D.SG....PRI..V..TICTGN..SRVN
Aquilegia_sp_TC23512#1_A                          SYFVPISAVIWQCLASIRE..E.PE....PRT..V..TIYRSD.....
G.max_Glyma08g11560.1#1_A                         PPFESLCAMIWRCMARIRP..G.SE....PKT..V..TVCRSN..PYKR
P.trichocarpa_549793#1_A                          PFFESLCAIMWQCIAKAKD..G.LE....PKV..V..TLCKKD..PNNP
O.basilicum_TA1387_39350#1_A                      PSFESLAAAIWQCIARIRA..D........SRV..V..NIFRKG..HEASS
B.napus_BN06MC34354_BNP3363_30@34198#1_A          SEVDILYALIWSSILNIRG..E.KD....TNV..I..TICDR......KT
A.thaliana_AT4G24510.1#1_A                        SEVDILYALIWKSLLNIRG..E.TN....TNV..I..TICDR......KK
A.thaliana_AT3G23840.1#1_A                        GEFEILTGIIWKCVATVRG..E.SA....PVT..I..TVIRSD..PKKL
A.thaliana_AT4G13840.1#1_A                        PVFEILAGIIWKCIAKVRV..E.PK....PVT..V..TIIKKD..PNDL
O.sativa_LOC_Os04g52164.1#1_A                     GTFELVSALLWQAVAKIRA..AASK...EVTT..V..TVVRTD..MAARS
T.aestivum_TC294447#1_A                           GSRRRLRAHIGAPMADGGQ..DQGHRRGEDGDGGEDRHVRLERLLPGQRA
A.thaliana_AT4G29250.1#1_A                        STFEILAGLFWVCVSRAKG..KRNE....LMD..M..SLCLD...VRKLL
G.max_Glyma17g31040.1#1_A                         PPFEALAAALFWVSLSKVKG..LRNR....LVD..M..SICLD...MRKVL
P.taeda_TA11048_3352#1_A                          TPFQALSALFWIACTKAKG..ITGA....EESK..L..SVCSE..FRKII
G.max_Glyma03g40670.1#1_A                         TPFDFLAALFWNRIARVKP..PKNH...HQTHCL..CICTD...FRNLI
Z.mays_ZM07MC26485_BFb0067H12@26407#1_A           TPFAALAALFWLRITGAAD..GERE.....L..TLALD...FRKRM
A.thaliana_AT1G27620.1#1_B                        TTFEALAANTWRSWAQSLD..LPMT...MLVK..L..LFSVN..MRKRL
A.thaliana_AT2G19070.1#1_B                        TRYETVTGHVWRCACKARG..HSPE....QPTA..L..GICID...TRSRM
P.trichocarpa_810871#1_B                          TRYETLSGHVWRSVCKARG..HNPE....QPTA..L..GVCVD...SRKRM
G.max_Glyma17g06860.1#1_B                         SRYEAIAGHIWRSACKARG..HKED....QPTT..L..TVIVD...SRSRM
```

FIGURE 8 (continued)

```
V.vinifera_GSVIVT00017176001#1_B    -RYEAVAGHIWRSACKARQ..HESQ...QPTT..L..SIIVD...ARNRM
Aquilegia_sp_TC20397#1_B             SRFEAMAAHIWRCASKARK..LQNA...QLTS..L..RIAAD...CRNRL
G.max_Glyma08g42490.1#1_B            SRFEAIAAHIWRCASKARAEYSNSN..HPTI..V..RFSVN...IRNRL
G.max_GM06MC27564_sae62b11@26939#1_B SRFEAIAAHIWRCASKARK..LDKN...QPTL..V..RFNAD...IRNRL
A.thaliana_AT5G48930.1#1_B           SSYEMLAGHVWRSVGKARG..LPND...QETK..L..YIATD...GRSRL
P.trichocarpa_587193#1_B             SSYEMLAAHVWRSTCKARE..LPDD...QETK..L..YIATD...GRSRW
G.max_Glyma13g44830.1#1_B            SSYEMLAGHVWRSVCKARA..LPDD...QETK..L..YIATD...GRARL
P.vulgaris_TC13456#1_B               STYEMLAAHIWRCLSKARG..LPED...QETR..L..YIPTN...GRSRL
L.sativa_TC19194#1_B                 STFVILAAHIWRCACKARG..LSHD...QPTK..L..YVATD...GRSRL
S.lycopersicum_TC201861#1_B          STYEILAAHIWRCTCKARG..LPED...QLTK..L..HVATD...GRSRL
P.trichocarpa_784746#1_B             STFETLAAHIWQCTCKARG..ISND...QATK..L..HIPTD...GRSRL
G.hirsutum_TC130878#1_B              STYTILVAYIWRCATKAWD..LSYD...QPTK..L..HMPTD...GRPRL
M.esculenta_TA8094_3983#1_B          -TYEILTAHIWRCTCKARA..LPYH...QLTK..L..LVPVD...GRSRL
M.truncatula_AC148816_16.4#1_B       -SFEVISGYLWRCVSKVRFE.GNWN...QPTR..L..TTLVN...CRNRL
A.thaliana_AT5G41040.1#1_B           -SFEALSAFVWRARTKSLK..MLSD...QKTK..L..LFAVD...GRAKF
A.thaliana_AT5G63560.1#1_B           -TFQTLTGFLWRARCQALG..LKPD...QRIK..L..LFAAD...GRSRF
B.napus_BN06MC25915_51267477@25820#1_B -TFQALTGFLWKSRCEALR..FKQD...QRVK..L..LFAAD...GRSRF
G.max_Glyma05g38290.1#1_B            STFEALTAFVWRARSEALGMHMDPN..QQTK..L..LFAVD...GRSKF
P.trichocarpa_807676#1_B             SNFTALTAFVWRARRCKALQ..MNPD...QTTP..L..LLVVD...VRSKL
P.patens_TC44371#1_B                 STTESLTGIILWRCITKARG..LSSD...IETR..T..TVACD...ARRRL
S.moellendorffii_431283#1_B          -SFEAAAALVWKSITEARD..LVDT...AIAT..F..VYSGSAKAGKNRR
B.napus_TC72743#1_B                  -RVESVTALLWKCFVFASS..LDTC...GRKV..L..IQLAD...LRSKL
P.trichocarpa_768990#1_B             -RVESVTALIWKCAMSASR..SNLG.VPRKAV..L..SLGVN...IRKRL
V.vinifera_GSVIVT00035108001#1_B     -RVEAVTSLIWKSAMDVAR..EKSGKDTISSI..V..THVVN...LRGKT
P.trifoliata_TA5574_37690#1_B        -RFEVVSAVILGALITATR..ESDDESNVPER..LDTIISVN...LRQRM
P.trichocarpa_579978#1_B             -RVKAVAALIWGSCIRVSQ..AVHG.RMRPSI..I..KFPIN...LRGKT
```

FIGURE 8 (continued)

```
                                                401                                                                      450
M.truncatula_CU137640_9.3#1_A                   E.....NEFPTNGSV.LSKIET..SLSPGESEISELVKLIAEK.KMNENH
M.truncatula_transferase_CER2-like#1_A          E.....NEFPTNDIL.LSKIET..NLRPEEYNILDLMNLIGEK.KINENY
P.trichocarpa_757078#1_A                        VKPNL.............................................
G.max_GM06MC00033_47170619@33#1_A               E.....NEFPTNGFLVLSKIEA..DFSTGKYEISELVKLIAEN.KMVENH
G.max_Glyma02g37870.1#1_A                       N.....IEFPTNGLV.LSVVEA..NVAVGQSDVSDLAKLIGEE.KRVENV
P.trichocarpa_558994#1_A                        D.....PEVPSNNIV.FSIIEA..DFSVAEGEIYELAELIAEK.QEEENS
Aquilegia_sp_TC235512#1_A                       G.....ERYLGNNPI.LTVVKA..DFSIAKSEPKELAALIMDQ.KVNERN
G.max_Glyma08g11560.1#1_A                       G.....NHIIGNNQV.ICKVDAASESSILDTDLTVLASMLVDQ.GVDERK
P.trichocarpa_549793#1_A                        K.....DGILSNSQI.ISSVKA..DSSVVDADLKELATLLVDQ.ATEENS
O.basilicum_TA1387_39350#1_A                    N.....NSILGNNQI.VSVVRA..AFAVAEANPSELAWMLKNE.ALDETK
B.napus_BN06MC34354_BNP3363_30@34198#1_A        S.....STCWNDDLV.ISVVER..KDEM..TEGSELAGLIANE.RKEENG
A.thaliana_AT4G24510.1#1_A                      S.....STCWNEDLV.ISVVEK..NDEM..VGISELAALIAGE.KREENG
A.thaliana_AT3G23840.1#1_A                      K.....PRAVRNGQM.ISSIHV..DFSVAEASLEEIVKSIGEA..KDERV
A.thaliana_AT4G13840.1#1_A                      K.....LNAIRNSQV.ISSVSV..DFPVAEATVEELVKAMGEA..KDERC
O.sativa_LOC_Os04g52164.1#1_A                   G.....KSLANEQR.VGYVEA..ASSPAKTDVAELAAMLAGDKVVDETG
T.aestivum_TC294447#1_A                         K.....CRVRGGGLC...........AGQHGRVRAGCAAGQQGSGRR......
A.thaliana_AT4G29250.1#1_A                      R.....LDQSYFGNCMV.YHKVPYSKPVTKDKLLFHAVQEIESITKRLDYD
G.max_Glyma17g31040.1#1_A                       G.....LDCTFFGNCMV.YNKVNV..EGNNYKFPQVVRAISDVVAKMDTE
P.taeda_TA11048_3352#1_A                        I.APLPHGFFGNALH.FSEVSS.SAGDLVGNDLSYPAKLIHDDIFRLDKD
G.max_Glyma03g40670.1#1_A                       K.ASLPIGYFGNALH.FSMLSQ....KVEDMQLGGIVSAVHSHLKGLSEE
Z.mays_ZM07MC26485_BFb0067H12@26407#1_A         Y.APLPWGYYGSSVH.FTRARA.......DLASGLPAVAAALDRHVAGVPEE
A.thaliana_AT1G27620.1#1_B                      T.PELPQGYYGNGFV.LACAES.KVQDLVNGNIYHAVKSIQEAKSRITDE
A.thaliana_AT2G19070.1#1_B                      E.PPLPRGYFGNATL.DVVAAS.TSGELISNELGFAASLISKAIKNVTNE
P.trichocarpa_810871#1_B                        Q..SPLPDGYLGNATL.NVIAVS.HAGELMSKPLGYAARKIREAIETMTNA
G.max_Glyma17g06860.1#1_B                       E.PPLPKGYFGNATL.DTVATS.LAGDLIVSKPLGYASSRIREAIERVSDE
```

| Sequence ID | Alignment |
|---|---|
| V.vinifera_GSVIVT00017176001#1_B | E.PPLPPRYFGNATF.RVTAES.TSGELVSKPLGYASGKARQAIEKATHE |
| Aquilegia_sp_TC20397#1_B | K.PTLPPGYYGNVIM.VTTPIA.EVSKLLVG.LGDACGIISQGVEKLTDD |
| G.max_Glyma08g42490.1#1_B | LTPPIPESYFGNALARTTTPKC.YEGDIISNPLSFAAQKLREAVNPITGE |
| G.max_GM06MC27564_sae62b11@26939#1_B | I.PPLPKNYFGNALS.LTTASC.HVGDVISNSLSYAAQKIREAIEVVTYE |
| A.thaliana_AT5G48930.1#1_B | R.PQLPPGYFGNVIF.TATPLA.VAGDLLSKPTWYAAGQIHDFLVRMDDN |
| P.trichocarpa_587193#1_B | Q.PQLPPGYFGNVIF.TATPIA.VAGEMQSKPTWYAAGKIHDALVRMDND |
| G.max_Glyma13g44830.1#1_B | Q.PPLPHGYFGNVIF.TTTRIA.VAGDLMSKPTWYAASRIHDALIRMDNE |
| P.vulgaris_TC13456#1_B | Q.PPLPPGYLGNAIF.STIPKA.FAGDLVSKPTWYAANQIHNALARMDNE |
| L.sativa_TC19194#1_B | N.PPLPPGYLGNVVF.TATPMA.NSGEFKSESLADTARRIHSKLSRMDDH |
| S.lycopersicum_TC201861#1_B | C.PPLPPGYLGNVVF.TATPIA.KSCELQSEPLTNSVKRIHNELIKMDDN |
| P.trichocarpa_784746#1_B | N.PPLPAGYCGNALF.TTAVLG.LSGEIQSKPLVHTITKIRGALKRMDNE |
| G.hirsutum_TC130878#1_B | H.PPLPSTYLGNAMF.AASLIA.LSGNLQSEPFVNTLERVHGTLQRMNNE |
| M.esculenta_TA8094_3983#1_B | H.PPLPPGFFGNVVF.TATLVV.LSGEILAETLKDTVERIHNELKRMDDE |
| M.truncatula_AC148816_16.4#1_B | N.PPLPMNYFGNATF.PTVTQTCSFDDVVNKPFCSVVGKVREAVKKVNDE |
| A.thaliana_AT5G41040.1#1_B | E.PQLPKGYFGNGIV.LTNSIC.EAGELIEKPLSFAVGLVREAIKMVTDG |
| A.thaliana_AT5G63560.1#1_B | V.PELPKGYSGNGIV.FTYCVT.TAGEVTLNPLSHSVCLVKRAVEMVNDG |
| B.napus_BN06MC25915_51267477@25820#1_B | I.PPLPKGYCGNGIV.LTGLVT.SSGELVGNPLSRSVGLVKSVVDLVTDS |
| G.max_Glyma05g38290.1#1_B | V.PPIPKGYFGNAIV.FSNALC.KVEELVNNPLSFSVGLVGKAIDMVTDS |
| P.trichocarpa_807676#1_B | N.PPLPKGYFGNGIV.LITCPG.RAGELIKNTLSFAVEEVQNGIKMVNEE |
| P.patens_TC44371#1_B | T.PSISEDYYGNVIF.HSCART.LVSQVTEEPLSYAAGVVHASIKRLDND |
| S.moellendorffii_431283#1_B | H.PPIPDEYCGTSAM.TIVLPC.PARDLKNKHISLAARLVHDDIRAITHE |
| B.napus_TC727743#1_B | P.SLLPESLIGNVMF.SSVVLS..TAQGEEVKIEEATRDLRKKREDLQTM |
| P.trichocarpa_768990#1_B | V.PTLPDNYGGNYVG.SISARI...EDHDDLELQGIVSRIRKDLIEFGEN |
| V.vinifera_GSVIVT00035108001#1_B | E.PPLSDRSLGNLWQ.QAVATV..TEQEGKVELDDLVGRLRRAIKKVDKE |
| P.trifoliata_TA5574_37690#1_B | N.PPFPEHCMGNIIS.GGLVYW...PLEKKVDYGCLAKEIHESIKKVDDQ |
| P.trichocarpa_579978#1_B | N.LPIPENSCGNFAG.WSAPHF.MPNDEGELKIHELVSRIHDGIEQTLTN |

FIGURE 8 (continued)

```
                                             451                                                  500
M.truncatula_CU137640_9.3#1_A                GLEKMMEEG..........EGKDDFIVY..............GAKLTF..VDL
M.truncatula_transferase_CER2-like#1_A       ALEKLVEKG..........DGKDDFFVY..............GAKLTF..VDL
P.trichocarpa_757078#1_A                     ...................................NFRCQV..ITL
G.max_GM06MC00033_47170619@33#1_A            VMEKLVEAD..........EGKEDFIVY..............GVNLTF..VNL
G.max_Glyma02g37870.1#1_A                    VVEKLVEES..........QGKGDFVVY..............GANLTF..VDL
P.trichocarpa_558994#1_A                     LIEDIVESD..........EVEFDRIAY..............GTNLTF..VDL
Aquilegia_sp_TC23512#1_A                     QIEQMVEKD..........QDMPDYIVF..............GANPTF..VDM
G.max_Glyma08g11560.1#1_A                    QIEEAVERD..........QGVSDFFVY..............GVNLTF..LDL
P.trichocarpa_549793#1_A                     QIEE...............................KRLIF..MDW
O.basilicum_TA1387_39350#1_A                 IIQQAVERD..........GGSSDFIIF..............GVNLSF..VNL
B.napus_BN06MC34354_BNP3363_30@34198#1_A     VIKGMIEKD..........RGYSDFITY..............GANLTF..VNL
A.thaliana_AT4G24510.1#1_A                   AIKRMIEQD..........KGSSDFFTY..............GANLTF..VNL
A.thaliana_AT3G23840.1#1_A                   VIDEIV.............DDVSDFIVY..............GANLTF..VDM
A.thaliana_AT4G13840.1#1_A                   GIEEIGESC..........DGNLDFVVY..............GAKLTF..LDL
O.sativa_LOC_Os04g52164.1#1_A                AVA................AFPGDVVVYG.............GANLTF..VDM
T.aestivum_TC294447#1_A                      ...........................................
A.thaliana_AT4G29250.1#1_A                   TVMDLIEWL..........SSNNGAISN..............GSDLVC..TNL
G.max_Glyma17g31040.1#1_A                    AIINLTEWLENN.......DVNSPTMMN..............NHNLVC..TSL
P.taeda_TA11048_3352#1_A                     ELRSVVEWLDKQKNSDGQLPPPFYLY................GPNLTA..VNG
G.max_Glyma03g40670.1#1_A                    EIWSTN.............NEGNYYCMY..............GTELTC..VCM
Z.mays_ZM07MC26485_BFb0067H12@26407#1_A      ELWRALEWLHTRQQ.....QENAPFQMY..............GPELTC..AAL
A.thaliana_AT1G27620.1#1_A                   YVRSTIDLLEDKTVKT.DV...............SCSIVI..SQW
A.thaliana_AT2G19070.1#1_A                   YVMIGIEYLKNQKDLK.KFQDLHA..LGSTEG.PFYG..NPNLGV..VSW
P.trichocarpa_810871#1_B                     YVRSAIDFLKNQPNLT.RFQDIHA..LGGTEG.PFYG..NPNIGV..VSW
G.max_Glyma17g06860.1#1_B                    YVRSGIEFLKNQEDLR.RFHQDLH.AIESEKKEPFYG..NPNLAV..VSW
```

FIGURE 8 (continued)

```
V.vinifera_GSVIVT00017176001#1_B          YLQSSLMYVKCQEDVT.PFRNFNT..VGCAKG.AFYG..NPNLEI..TSW
Aquilegia_sp_TC20397#1_B                  YIKSATDFLASQEDLT.QWRTGFH..TDSKKG.LFLG..NPNMAI..TSW
G.max_Glyma08g42490.1#1_B                 YIKSQLSVGLGQEQLD.HIRAFFMRQEHGMKTPYIAGEHNNVILL..TSL
G.max_GM06MC27564_sae62b11@26939#1_B      YIWSQIDVIRGQEQID.NARALFFGQNEGKDA.LFYG..NPNLLI..TSW
A.thaliana_AT5G48930.1#1_B                YLRSALDYLEMQPDLS.ALVRGAH........TYK..CPNLGI..TSW
P.trichocarpa_587193#1_B                  YLKSALDYLELQPDLS.ALVRGAH........SFR..CPNLGI..TSW
G.max_Glyma13g44830.1#1_B                 YLRSALDYLELQPDLK.SLVRGAH........TFR..CPNLGI..TSW
P.vulgaris_TC13456#1_B                    YMRSALDYLQLQPDIN.SLLPIAH........TSR..YPIVRI..NSW
L.sativa_TC19194#1_B                      YMRSAIDYLELQSDLS.TLIRGPT........YFA..SPNLNV..NSW
S.lycopersicum_TC201861#1_B               YLRSALDYLELQPDLS.TLIRGPA........YFA..SPNLNI..NSW
P.trichocarpa_784746#1_B                  YLRSAIDYLHVQPNLE.ALKRGPH........TFK..NPNLNI..VSW
G.hirsutum_TC130878#1_B                   YLRSALDYLETLPDIT.VARRTPD........TYH..CPNLSI..NKW
M.esculenta_TA80943983#1_B                YMRSAIDYLEVLDDLT.PTFRGAN........TCR..CPNISI..VSW
M.truncatula_AC148816_16.4#1_B            YVRSVLDYVANQKDMN.LLRDKFY..NFAKRNGQFGG.EPNLYV..VGW
A.thaliana_AT5G41040.1#1_B                YMRSAIDYFEVTRARP.SL..............SSTLLI..TTW
A.thaliana_AT5G63560.1#1_B                FMRSAIDYFEVTRARP.SL..............TATLLI..TSW
B.napus_BN06MC25915_512674770@25820#1_B   FMRSAIDYLEVNRNRP.SM..............TGTLLI..TSW
G.max_Glyma05g38290.1#1_B                 YMRSAIDYFEVKRSRP.SL..............TATLLI..TTW
P.trichocarpa_807676#1_B                  FVRSWIDYLEVMGAKDFPL..............HSYFKV..SSW
P.patens_TC44371#1_B                      YIRSAIDYIEHRRQNTASYGRTLSTVL......SPDLSL..TSW
S.moellendorffii_431283#1_B               RFQSTIDWMELEGIGG.PGRKEIAVNM......RAEMAVYSVDL
B.napus_TC72743#1_B                       IQDEDGSSSMIGSKIA.NLMLTNYARMSYET..HEPYTV..SSW
P.trichocarpa_768990#1_B                  YAKITQGDDTSLAICK.AVEEFGKMAMSKD...IDSYNG..TSW
V.vinifera_GSVIVT00035108001#1_B          YVKEIQGEEGLSKACG.AMKEVQKMIMSKGE..MELYRF..SSW
P.trifoliata_TA5574_37690#1_B             FARKFYGDAEFLNLPRLAGAEDVK.........KREFWV..TSW
P.trichocarpa_579978#1_B                  YAKASSSDEFFIMVMN.DFRKLDEALKQTEQ..........QDVYLF..SCW
```

| Sequence | | | |
|---|---|---|---|
| V.vinifera_GSVIVT00017176001#1_B | ARL........PIYG.ADFGWG.EEIYMGPGEI.GYD..GKVFVFPGQGL |
| Aquilegia_sp_TC20397#1_B | FGL........PIYD.ADFGWG.KPIFMGPAGL.GFD..GRAFIIPGSDE |
| G.max_Glyma08g42490.1#1_B | MTM........PVYE.ADFGWG.KPMQFGLPRG.SLD..DRVGILPSPDG |
| G.max_GM06MC27564_sae62b11@26939#1_B | MSM........PMHE.ADFGWG.KPVYLGLGSV.STQ..DRALIQSPDG |
| A.thaliana_AT5G48930.1#1_B | VRL........PIYD.ADFGWG.RPIFMGPGGI.PYE..GLSFVLPSPTN |
| P.trichocarpa_587193#1_B | VRL........PIHD.ADFGWG.RPIFMGPGGI.AYE..GLSFIIPSPTN |
| G.max_Glyma13g44830.1#1_B | ARL........PIHD.ADFGWG.RPIFMGPGGI.AYE..GLSFIIPSSTN |
| P.vulgaris_TC13456#1_B | AKF........PIYD.ADFGWG.RPIFMRPAWI.VHE..GQSMILPSPTN |
| L.sativa_TC19194#1_B | TRL........PLYE.SDFGWG.KPIFMGPASI.LYE..GTIYIIPNPND |
| S.lycopersicum_TC201861#1_B | TRL........PVHE.CDFGWG.RPIHMGPACI.LYE..GTIYIIPSPNS |
| P.trichocarpa_784746#1_B | MTM........PIYD.ADFGWG.RPYFMGPAIV.GFE..GMAYIARCPNN |
| G.hirsutum_TC130878#1_B | TRL........SLYD.ADFGWG.RPIYMGPANV.VHE..GKIYILPSPTN |
| M.esculenta_TA8094_3983#1_B | MRL........PFYD.ADFGMG.KPIFVRPAN..PLE..GKGNIMRTQSD |
| M.truncatula_AC148816_16.4#1_B | TNF........PFNE.SDFGWG.KPDCMVPGIV.NSDGIGKAYILDEANG |
| A.thaliana_AT5G41040.1#1_B | SRL........GFHT.TDFGWG.EPILSGPVAL.PEK..EVTLFLSHGEQ |
| A.thaliana_AT5G63560.1#1_B | AKL........SFHT.KDFGWG.EPVVSGPVGL.PEK..EVILFLPCGSD |
| B.napus_BN06MC25915_51267477@25820#1_B | SRL........SLHK.IDFGWG.EPVFSGPVGL.PGR..EVILFLPGLED |
| G.max_Glyma05g38290.1#1_B | TRI........PFRS.ADFGWG.KPFFFGPVTL.PGK..EVILFLSHNEE |
| P.trichocarpa_807676#1_B | TRL........SIEC.SDFGWG.EPAQFACTNL.PK...NSAFFLPDGKE |
| P.patens_TC44371#1_B | LQM........PLYK.IDFGWG.TPVYAGPPYV.PFE..GLIILNASHTQ |
| S.moellendorffii_431283#1_B | VTF........PVYD.VDFGWG.RPAHFSLVLE.PWYGNGVVVFLPTAQG |
| B.napus_TC72743#1_B | CRL........PLYE.ASFGWG.YPVWVVGNVAPTFE..NIAMLIDSKDG |
| P.trichocarpa_768990#1_B | CRF........ELYD.ADFGWG.KPTWLSNVFTIELK..NIMCLIDTRDG |
| V.vinifera_GSVIVT00035108001#1_B | SRF........PFYE.TDFGFG.RPIWCTITA.PIK..NVIIMDTKSG |
| P.trifoliata_TA5574_37690#1_B | CKT........PFYE.ADFGWG.KPKWAGNSMR..LN..QITVFFDSSDG |
| P.trichocarpa_579978#1_B | CRF........PMYE.ADFGWG.KPSLVSRGVQ.AHK..EMILLFDTKDG |

FIGURE 8 (continued)

```
                                                           551                                                  600
M.truncatula_CU137640_9.3#1_A                              YNG...NNGRMSFSCKLQPWNFLRESEQRGDTTTATTITTTSTTVSVTMA
M.truncatula_transferase_CER2-like#1_A                     DDG...NNGRM.........................IKVSLP
P.trichocarpa_757078#1_A                                   .................................NT
G.max_GM06MC00033_47170619@33#1_A                          DEDG..GNGRI.........................VTVSLP
G.max_Glyma02g37870.1#1_A                                  EENGR.NIGRM.........................VTVSLP
P.trichocarpa_558994#1_A                                   NGSGKVSSGRT.........................VTVTLP
Aquilegia_sp_TC235512#1_A                                  ......GRT...........................VTITMP
G.max_Glyma08g11560.1#1_A                                  SMENG.VDGKF.........................LTMIFP
P.trichocarpa_549793#1_A                                   ....................................LLWYFH
O.basilicum_TA1387_39350#1_A                               K.....SGGRL.........................VTVTLP
B.napus_BN06MC34354_BNP3363_30@34198#1_A                   ......KFARA.........................VSVVMP
A.thaliana_AT4G24510.1#1_A                                 ......NFARI.........................VSVVMP
A.thaliana_AT3G23840.1#1_A                                 ......EERV..........................VTVTLP
A.thaliana_AT4G13840.1#1_A                                 ......EERV..........................VTVTLP
O.sativa_LOC_Os04g52164.1#1_A                              ......RGRV..........................VTVVIP
T.aestivum_TC294447#1_A                                    ARTRGVRHGRR.........................RSGGCR
A.thaliana_AT4G29250.1#1_A                                 KE....PMSRV.........................VMVSLP
G.max_Glyma17g31040.1#1_A                                  EG....PLSRV.........................AMVTLR
P.taeda_TA11048_3352#1_A                                   ......GSSRT.........................VMVTLP
G.max_Glyma03g40670.1#1_A                                  ......GLSRT.........................VMVMLP
Z.mays_ZM07MC26485_BFb0067H12@26407#1_A                    ......GEARD.........................VVVTLP
A.thaliana_AT1G27620.1#1_B                                 ......NDAIR.........................VQMSLP
A.thaliana_AT2G19070.1#1_B                                 ......DGSVI.........................LATCLQ
P.trichocarpa_810871#1_B                                   ......DGSVI.........................LAICLQ
G.max_Glyma17g06860.1#1_B                                  ......DGSLL.........................VCLGLQ
```

FIGURE 8 (continued)

| | | |
|---|---|---|
| V.vinifera_GSVIVT00017176001#1_B | ...DGSFL... | ...VALRLQ |
| Aquilegia_sp_TC20397#1_B | ...DGSFV... | ...IAIRLQ |
| G.max_Glyma08g42490.1#1_B | ...DG.VV... | ...VNVFFQ |
| G.max_GM06MC27564_sae62b11@26939#1_B | ...DGSII... | ...LSIHFQ |
| A.thaliana_AT5G48930.1#1_B | ...DGSLS... | ...VAIALQ |
| P.trichocarpa_587193#1_B | ...DGSMS... | ...VAISLQ |
| G.max_Glyma13g44830.1#1_B | ...DGSLS... | ...LAIALP |
| P.vulgaris_TC13456#1_B | ...DGNLY... | ...LVINLP |
| L.sativa_TC19194#1_B | ...DRALK... | ...LAVCLD |
| S.lycopersicum_TC201861#1_B | ...KDRNLR... | ...LAVCLD |
| P.trichocarpa_784746#1_B | ...DGSLM... | ...IFTCLE |
| G.hirsutum_TC130878#1_B | ...DGSLS... | ...LVACLQ |
| M.esculenta_TA8094_3983#1_B | ...DGSCQ... | ...LAICLQ |
| M.truncatula_AC148816_16.4#1_B | ...DGFV... | ...VSVCLQ |
| A.thaliana_AT5G41040.1#1_B | ...RRSIN... | ...VLLGLP |
| A.thaliana_AT5G63560.1#1_B | ...TKSIN... | ...VLLGLP |
| B.napus_BN06MC25915_512674770@25820#1_B | ...MKSIN... | ...VFLGLP |
| G.max_Glyma05g38290.1#1_B | ...SKSIN... | ...VLLGLP |
| P.trichocarpa_807676#1_B | ...KKGIN... | ...LILDLP |
| P.patens_TC44371#1_B | ...DGSVD... | ...AILALF |
| S.moellendorffii_431283#1_B | ...G.TRERR... | ...IVVMLL |
| B.napus_TC72743#1_B | ...HGIE... | ...AFVTLP |
| P.trichocarpa_768990#1_B | ...DGIE... | ...ACISLS |
| V.vinifera_GSVIVT00035108001#1_B | ...GGIE... | ...AWVTMV |
| P.trifoliata_TA5574_37690#1_B | ...EGVE... | ...AWVGLP |
| P.trichocarpa_579978#1_B | ...NGID... | ...AWVSLE |

FIGURE 8 (continued)

```
                                                         601                                                                      633
M.truncatula_CU137640_9.3#1_A                            TTNIATTTFVLR~~~~~~~~~~~~~~~~~~~~~~
M.truncatula_transferase_CER2-like#1_A                   GKELDQLKYKLEREWGIQHYASLTF~~~~~~~~~
P.trichocarpa_757078#1_A                                 SDHIKTI~~~~~~~~~~~~~~~~~~~~~~~~~~~
G.max_GM06MC00033_47170619@33#1_A                        REELYQLKDKLGGEWGIH~~~~~~~~~~~~~~~~
G.max_Glyma02g37870.1#1_A                                EKEVDQLKEKLRGEWGPESLPF~~~~~~~~~~~~
P.trichocarpa_558994#1_A                                 ENQLSRLMNELKLHWGLA~~~~~~~~~~~~~~~~
Aquilegia_sp_TC235512#1_A                                EGQISELKAEMKMKWNIG~~~~~~~~~~~~~~~~
G.max_Glyma08g11560.1#1_A                                EDEMVKLKSELKIIGLLLENN~~~~~~~~~~~~~
P.trichocarpa_549793#1_A                                 GQKIQARMATLEGSWW~~~~~~~~~~~~~~~~~~
O.basilicum_TA1387_39350#1_A                             ENEVGVKSELKREGLMA~~~~~~~~~~~~~~~~~
B.napus_BN06MC34354_BNP3363_30@34198#1_A                 EEELAKLKIEVNNMIM~~~~~~~~~~~~~~~~~~
A.thaliana_AT4G24510.1#1_A                               EEDLAKLKEEVTNMII~~~~~~~~~~~~~~~~~~
A.thaliana_AT3G23840.1#1_A                               VDEIEKVKWEMKKCGLITPLV~~~~~~~~~~~~~
A.thaliana_AT4G13840.1#1_A                               EEEEMERVKLEFKKFGLIAP~~~~~~~~~~~~~~
O.sativa_LOC_Os04g52164.1#1_A                            RDEVDSLRAALGSTLLLQDA~~~~~~~~~~~~~~
T.aestivum_TC294447#1_A                                  AGAVRRQRAWPRHHGGAPQ~~~~~~~~~~~~~~~
A.thaliana_AT4G29250.1#1_A                               QRVMVKIEDELLLSFSPVVIMEDTKQL~~~~~~~
G.max_Glyma17g31040.1#1_A                                KEEAIKICEDDLISQFSPTILMKCE~~~~~~~~~
P.taeda_TA11048_3352#1_A                                 ATQASQLSMDPALLRFSPTIWMNNVA~~~~~~~~
G.max_Glyma03g40670.1#1_A                                EEELAELSKDEAILELEPAMLLAGSVVSGGPLT
Z.mays_ZM07MC26485_BFb0067H12@26407#1_A                  AGATARVCRDAEVLRHGAEVVFGAKAEKEE~~~
A.thaliana_AT1G27620.1#1_B                               EEVVKRLEYCMVKFLDGKDNEDENSRAC~~~~~
A.thaliana_AT2G19070.1#1_B                               VAHMEAFKKHFYEDI~~~~~~~~~~~~~~~~~~
P.trichocarpa_810871#1_B                                 VAHMEAFKKYFYEDI~~~~~~~~~~~~~~~~~~
G.max_Glyma17g06860.1#1_B                                VEHMDAFKKHFYEDIESKS~~~~~~~~~~~~~~
```

FIGURE 8 (continued)

| | |
|---|---|
| V.vinifera_GSVIVT00017176001#1_B | VRHIDAFQKFFNEDICSQKPLSINPSL~~~~~~ |
| Aquilegia_sp_TC20397#1_B | VTHMDDFEKFFYENI~~~~~~~~~~~~~~~~~ |
| G.max_Glyma08g42490.1#1_B | EAILQRFKKLFYEDVYISSL~~~~~~~~~~~~ |
| G.max_GM06MC27564_sae62b11@26939#1_B | MEHMQLLKKYFYKDI~~~~~~~~~~~~~~~~~ |
| A.thaliana_AT5G48930.1#1_B | SEHMKLFEKFLFEI~~~~~~~~~~~~~~~~~~ |
| P.trichocarpa_587193#1_B | AQHMKLFEKFIYDI~~~~~~~~~~~~~~~~~~ |
| G.max_Glyma13g44830.1#1_B | PEQMKVFQELFYDDI~~~~~~~~~~~~~~~~~ |
| P.vulgaris_TC13456#1_B | PHHMKLFQEFLYDI~~~~~~~~~~~~~~~~~~ |
| L.sativa_TC19194#1_B | SEHMSLFKKYLYDF~~~~~~~~~~~~~~~~~~ |
| S.lycopersicum_TC201861#1_B | AGHMSLFEKYLYEL~~~~~~~~~~~~~~~~~~ |
| P.trichocarpa_784746#1_B | SNHMELFKKSFYDF~~~~~~~~~~~~~~~~~~ |
| G.hirsutum_TC130878#1_B | TAHMKLFEKHLYEGLKSFDKIKARY~~~~~~~ |
| M.esculenta_TA8094_3983#1_B | EDHMQSFQKLFYEF~~~~~~~~~~~~~~~~~~ |
| M.truncatula_AC148816_16.4#1_B | PFHIDALKKLFYEDMEMITSSKL~~~~~~~~~ |
| A.thaliana_AT5G41040.1#1_B | ATAMDVFQEQFLQI~~~~~~~~~~~~~~~~~~ |
| A.thaliana_AT5G63560.1#1_B | GSAMKVFQGIMDI~~~~~~~~~~~~~~~~~~~ |
| B.napus_BN06MC25915_51267477@25820#1_B | ASAMKVFEELMKI~~~~~~~~~~~~~~~~~~~ |
| G.max_Glyma05g38290.1#1_B | ASAMKRFERLMEI~~~~~~~~~~~~~~~~~~~ |
| P.trichocarpa_807676#1_B | VTAMSTFQELMLL~~~~~~~~~~~~~~~~~~~ |
| P.patens_TC44371#1_B | EDDMAKFENICFEVPN~~~~~~~~~~~~~~~~ |
| S.moellendorffii_431283#1_B | EDEMKRLLRSELLAKFATLE~~~~~~~~~~~~ |
| B.napus_TC72743#1_B | EENMSSLEQNSELLAFASLNPCVLV~~~~~~~ |
| P.trichocarpa_768990#1_B | REDMALFESNKELLEFAAANPSVSV~~~~~~~ |
| V.vinifera_GSVIVT00035108001#1_B | EEDMTKFQRHYELLEFVSSTQSA~~~~~~~~~ |
| P.trifoliata_TA5574_37690#1_B | KKDIARFEKDSGILAYTSPNPSIF~~~~~~~~ |
| P.trichocarpa_579978#1_B | ENNMLFKQDPDLLAFTT~~~~~~~~~~~~~~~ |

FIGURE 8 (continued)

| | 1 | 2 | 3 | 4 | 5 | 6 | 7 | 8 | 9 | 10 | 11 | 12 | 13 |
|---|---|---|---|---|---|---|---|---|---|---|---|---|---|
| 1. M.truncatula_CU137640_9.3#1_A | | 68.50 | 61.50 | 53.40 | 43.90 | 37.10 | 33.80 | 36.90 | 33.50 | 32.40 | 33.90 | 27.80 | 31.40 |
| 2. M.truncatula_transferase_CER2-like#1_A | | | 63.90 | 55.90 | 45.20 | 38.50 | 37.40 | 39.70 | 35.00 | 36.20 | 38.20 | 30.00 | 34.80 |
| 3. G.max_GM06MC00033_47170619@33#1_A | | | | 60.20 | 48.50 | 41.20 | 39.50 | 38.80 | 35.60 | 33.70 | 37.20 | 29.80 | 36.00 |
| 4. G.max_Glyma02g37870.1#1_A | | | | | 46.80 | 40.80 | 38.80 | 40.70 | 36.00 | 35.10 | 38.20 | 32.20 | 36.20 |
| 5. P.trichocarpa_558994#1_A | | | | | | 49.00 | 40.70 | 41.80 | 39.20 | 36.00 | 42.00 | 35.20 | 42.00 |
| 6. Aquilegia_sp_TC23512#1_A | | | | | | | 36.90 | 36.70 | 36.80 | 34.70 | 45.10 | 40.30 | 42.10 |
| 7. B.napus_BN06MC34354_BNP3363_30@34198#1_A | | | | | | | | 72.70 | 33.10 | 33.00 | 34.50 | 27.80 | 34.40 |
| 8. A.thaliana_AT4G24510.1#1_A | | | | | | | | | 35.60 | 33.30 | 35.00 | 29.10 | 35.90 |
| 9. A.thaliana_AT3G23840.1#1_A | | | | | | | | | | 64.00 | 40.00 | 34.60 | 38.50 |
| 10. A.thaliana_AT4G13840.1#1_A | | | | | | | | | | | 40.20 | 37.90 | 40.20 |
| 11. G.max_Glyma08g11560.1#1_A | | | | | | | | | | | | 43.90 | 44.50 |
| 12. P.trichocarpa_549793#1_A | | | | | | | | | | | | | 35.90 |
| 13. O.basillicum_TA1387_39350#1_A | | | | | | | | | | | | | |
| 14. O.sativa_LOC_Os04g52164.1#1_A | | | | | | | | | | | | | |
| 15. T.aestivum_TC294447#1_A | | | | | | | | | | | | | |
| 16. A.thaliana_AT4G29250.1#1_A | | | | | | | | | | | | | |
| 17. G.max_Glyma17g31040.1#1_A | | | | | | | | | | | | | |
| 18. P.taeda_TA11048_3352#1_A | | | | | | | | | | | | | |
| 19. G.max_Glyma03g40670.1#1_A | | | | | | | | | | | | | |
| 20. Z.mays_ZM07MC26485_BF00067H12@26407#1_A | | | | | | | | | | | | | |
| 21. P.trichocarpa_757078#1_A | | | | | | | | | | | | | |
| 22. Z.mays_Glossy2_X87779_#1_A | | | | | | | | | | | | | |
| 23. A.thaliana_AT1G27620.1#1_B | | | | | | | | | | | | | |
| 24. A.thaliana_AT2G19070.1#1_B | | | | | | | | | | | | | |
| 25. A.thaliana_AT5G41040.1#1_B | | | | | | | | | | | | | |
| 26. A.thaliana_AT5G48930.1#1_B | | | | | | | | | | | | | |

FIGURE 10

| | | | | | | | | | | | | | | | | | | | | | | | | |
|---|---|---|---|---|---|---|---|---|---|---|---|---|---|---|---|---|---|---|---|---|---|---|---|---|
| 27. A.thaliana_AT5G63560.1#1_B | | | | | | | | | | | | | | | | | | | | | | | | |
| 28. Aquilegia_sp_TC20397#1_B | | | | | | | | | | | | | | | | | | | | | | | | |
| 29. B.napus_BN06MC25915_51267477@25820#1_B | | | | | | | | | | | | | | | | | | | | | | | | |
| 30. B.napus_TC72743#1_B | | | | | | | | | | | | | | | | | | | | | | | | |
| 31. G.hirsutum_TC130878#1_B | | | | | | | | | | | | | | | | | | | | | | | | |
| 32. G.max_Glyma05g38290.1#1_B | | | | | | | | | | | | | | | | | | | | | | | | |
| 33. G.max_Glyma08g42490.1#1_B | | | | | | | | | | | | | | | | | | | | | | | | |
| 34. G.max_Glyma13g44830.1#1_B | | | | | | | | | | | | | | | | | | | | | | | | |
| 35. G.max_Glyma17g06860.1#1_B | | | | | | | | | | | | | | | | | | | | | | | | |
| 36. G.max_GM06MC27564_sae62b11@26939#1_B | | | | | | | | | | | | | | | | | | | | | | | | |
| 37. L.sativa_TC19194#1_B | | | | | | | | | | | | | | | | | | | | | | | | |
| 38. M.esculenta_TA8094_3983#1_B | | | | | | | | | | | | | | | | | | | | | | | | |
| 39. M.truncatula_AC148816_16.4#1_B | | | | | | | | | | | | | | | | | | | | | | | | |
| 40. P.trichocarpa_579978#1_B | | | | | | | | | | | | | | | | | | | | | | | | |
| 41. P.trichocarpa_587193#1_B | | | | | | | | | | | | | | | | | | | | | | | | |
| 42. P.trichocarpa_768990#1_B | | | | | | | | | | | | | | | | | | | | | | | | |
| 43. P.trichocarpa_784746#1_B | | | | | | | | | | | | | | | | | | | | | | | | |
| 44. P.trichocarpa_807676#1_B | | | | | | | | | | | | | | | | | | | | | | | | |
| 45. P.trichocarpa_810871#1_B | | | | | | | | | | | | | | | | | | | | | | | | |
| 46. P.trifoliata_TA5574_37690#1_B | | | | | | | | | | | | | | | | | | | | | | | | |
| 47. P.vulgaris_TC13456#1_B | | | | | | | | | | | | | | | | | | | | | | | | |
| 48. S.lycopersicum_TC201861#1_B | | | | | | | | | | | | | | | | | | | | | | | | |
| 49. V.vinifera_GSVIVT00017176001#1_B | | | | | | | | | | | | | | | | | | | | | | | | |
| 50. V.vinifera_GSVIVT00035108001#1_B | | | | | | | | | | | | | | | | | | | | | | | | |
| 51. S.moellendorffii_431283#1_B | | | | | | | | | | | | | | | | | | | | | | | | |
| 52. P.patens_TC44371#1_B | | | | | | | | | | | | | | | | | | | | | | | | |

FIGURE 10 (conitnued)

| | 14 | 15 | 16 | 17 | 18 | 19 | 20 | 21 | 22 | 23 | 24 | 25 | 26 |
|---|---|---|---|---|---|---|---|---|---|---|---|---|---|
| 1. M.truncatula_CU137640_9.3#1_A | 31.60 | 23.70 | 20.70 | 21.60 | 22.90 | 20.50 | 22.00 | 20.90 | 32.10 | 20.30 | 20.70 | 20.00 | 19.80 |
| 2. M.truncatula_transferase_CER2-like#1_A | 33.60 | 25.90 | 21.40 | 22.90 | 24.60 | 22.30 | 24.00 | 20.40 | 34.40 | 21.10 | 21.20 | 19.20 | 19.70 |
| 3. G.max_GM06MC00033_47170619@33#1_A | 35.10 | 26.50 | 22.30 | 23.20 | 25.40 | 24.10 | 23.10 | 19.80 | 36.90 | 22.40 | 23.40 | 20.90 | 20.20 |
| 4. G.max_Glyma02g37870.1#1_A | 36.50 | 26.20 | 23.20 | 23.60 | 26.70 | 24.10 | 23.30 | 19.50 | 35.30 | 22.60 | 22.30 | 20.00 | 21.70 |
| 5. P.trichocarpa_558994#1_A | 36.70 | 28.00 | 23.00 | 22.80 | 25.90 | 23.00 | 23.20 | 21.20 | 36.10 | 22.60 | 21.50 | 20.60 | 20.10 |
| 6. Aquilegia_sp_TC23512#1_A | 38.00 | 28.40 | 18.80 | 21.20 | 24.10 | 23.10 | 21.70 | 19.00 | 37.30 | 20.00 | 24.00 | 18.40 | 22.30 |
| 7. B.napus_BN06MC34354_BNP3363_30@34198#1_A | 32.90 | 25.10 | 20.80 | 23.00 | 24.40 | 24.10 | 21.00 | 20.20 | 32.40 | 16.10 | 20.50 | 18.70 | 20.80 |
| 8. A.thaliana_AT4G24510.1#1_A | 33.40 | 23.90 | 20.60 | 25.10 | 26.20 | 23.60 | 22.80 | 21.30 | 32.50 | 18.30 | 18.50 | 20.00 | 19.50 |
| 9. A.thaliana_AT3G23840.1#1_A | 36.40 | 30.20 | 22.70 | 23.20 | 24.70 | 24.00 | 25.20 | 21.40 | 36.80 | 21.30 | 18.90 | 17.10 | 21.30 |
| 10. A.thaliana_AT4G13840.1#1_A | 32.70 | 28.20 | 21.90 | 24.10 | 24.30 | 24.70 | 24.10 | 18.30 | 33.60 | 19.70 | 19.50 | 17.60 | 22.90 |
| 11. G.max_Glyma08g11560.1#1_A | 38.00 | 25.10 | 19.50 | 23.50 | 23.20 | 23.10 | 23.00 | 20.80 | 36.30 | 19.00 | 23.30 | 21.60 | 21.40 |
| 12. P.trichocarpa_549793#1_A | 33.10 | 26.90 | 18.20 | 20.20 | 21.50 | 19.80 | 22.50 | 22.50 | 33.00 | 20.40 | 20.80 | 20.80 | 20.00 |
| 13. O.basilicum_TA1387_39350#1_A | 36.80 | 26.70 | 20.60 | 25.30 | 24.90 | 24.20 | 25.50 | 22.20 | 35.60 | 19.80 | 21.60 | 20.10 | 22.10 |
| 14. O.sativa_LOC_Os04g52164.1#1_A | | 42.60 | 22.30 | 22.10 | 24.60 | 22.50 | 25.90 | 19.10 | 72.00 | 21.50 | 22.20 | 20.70 | 22.00 |
| 15. T.aestivum_TC294447#1_A | | | 18.90 | 19.70 | 20.50 | 18.80 | 24.80 | 19.90 | 41.20 | 17.20 | 19.00 | 18.70 | 22.30 |
| 16. A.thaliana_AT4G29250.1#1_A | | | | 46.20 | 32.90 | 30.60 | 31.20 | 21.50 | 21.60 | 20.50 | 20.60 | 20.90 | 22.00 |
| 17. G.max_Glyma17g31040.1#1_A | | | | | 37.40 | 30.80 | 30.70 | 21.50 | 23.40 | 20.80 | 23.10 | 22.70 | 23.90 |
| 18. P.taeda_TA11048_3352#1_A | | | | | | 36.10 | 33.90 | 21.50 | 26.70 | 19.70 | 23.90 | 22.80 | 23.90 |
| 19. G.max_Glyma03g40670.1#1_A | | | | | | | 35.30 | 19.20 | 22.30 | 20.30 | 20.10 | 21.20 | 21.80 |
| 20. Z.mays_ZM07MC26485_BFb0067H12@26407#1_A | | | | | | | | 18.80 | 26.30 | 19.50 | 21.80 | 20.40 | 21.50 |
| 21. P.trichocarpa_757078#1_A | | | | | | | | | 19.90 | 17.80 | 19.20 | 17.20 | 19.60 |
| 22. Z.mays_Glossy2_X88779_#1_A | | | | | | | | | | 20.70 | 21.80 | 23.30 | 22.20 |
| 23. A.thaliana_AT1G27620.1#1_B | | | | | | | | | | | 26.20 | 30.40 | 27.80 |
| 24. A.thaliana_AT2G19070.1#1_B | | | | | | | | | | | | 30.60 | 37.20 |
| 25. A.thaliana_AT5G41040.1#1_B | | | | | | | | | | | | | 32.50 |
| 26. A.thaliana_AT5G48930.1#1_B | | | | | | | | | | | | | |

FIGURE 10 (conitnued)

| | |
|---|---|
| 27. A.thaliana_AT5G63560.1#1_B | |
| 28. Aquilegia_sp_TC20397#1_B | |
| 29. B.napus_BN06MC25915_51267477@25820#1_B | |
| 30. B.napus_TC72743#1_B | |
| 31. G.hirsutum_TC130878#1_B | |
| 32. G.max_Glyma05g38290.1#1_B | |
| 33. G.max_Glyma08g42490.1#1_B | |
| 34. G.max_Glyma13g44830.1#1_B | |
| 35. G.max_Glyma17g06860.1#1_B | |
| 36. G.max_GM06MC27564_sae62b11@26939#1_B | |
| 37. L.sativa_TC19194#1_B | |
| 38. M.esculenta_TA8094_3983#1_B | |
| 39. M.truncatula_AC148816_16.4#1_B | |
| 40. P.trichocarpa_579978#1_B | |
| 41. P.trichocarpa_587193#1_B | |
| 42. P.trichocarpa_768990#1_B | |
| 43. P.trichocarpa_784746#1_B | |
| 44. P.trichocarpa_807676#1_B | |
| 45. P.trichocarpa_810871#1_B | |
| 46. P.trifoliata_TA5574_37690#1_B | |
| 47. P.vulgaris_TC13456#1_B | |
| 48. S.lycopersicum_TC201861#1_B | |
| 49. V.vinifera_GSVIVT00017176001#1_B | |
| 50. V.vinifera_GSVIVT00035108001#1_B | |
| 51. S.moellendorffii_431283#1_B | |
| 52. P.patens_TC44371#1_B | |

FIGURE 10 (conitnued)

| | 27 | 28 | 29 | 30 | 31 | 32 | 33 | 34 | 35 | 36 | 37 | 38 | 39 |
|---|---|---|---|---|---|---|---|---|---|---|---|---|---|
| 1. M.truncatula_CU137640_9.3#1_A | 20.00 | 20.00 | 21.20 | 21.00 | 19.10 | 19.20 | 20.80 | 20.70 | 20.60 | 22.50 | 19.50 | 21.90 | 20.40 |
| 2. M.truncatula_transferase_CER2-like#1_A | 19.20 | 20.40 | 22.40 | 20.90 | 20.30 | 18.70 | 22.30 | 20.30 | 21.30 | 21.60 | 20.90 | 19.60 | 22.20 |
| 3. G.max_GM06MC00033_47170619@33#1_A | 20.60 | 18.70 | 22.20 | 20.60 | 20.10 | 19.90 | 20.50 | 19.10 | 21.90 | 20.60 | 20.40 | 22.10 | 23.20 |
| 4. G.max_Glyma02g37870.1#1_A | 20.30 | 19.30 | 21.90 | 20.80 | 20.70 | 20.30 | 20.10 | 20.50 | 20.30 | 21.10 | 21.10 | 21.20 | 22.30 |
| 5. P.trichocarpa_558994#1_A | 21.60 | 21.10 | 20.60 | 22.80 | 22.60 | 21.40 | 21.40 | 21.70 | 22.40 | 22.30 | 24.10 | 22.90 | 21.30 |
| 6. Aquilegia_sp_TC23512#1_A | 18.60 | 19.70 | 20.20 | 20.70 | 23.80 | 19.40 | 22.20 | 21.40 | 21.80 | 21.20 | 22.60 | 21.10 | 21.80 |
| 7. B.napus_BN06MC34354_BNP3363_30@34198#1_A | 19.80 | 19.10 | 18.90 | 20.20 | 17.90 | 19.80 | 19.20 | 18.90 | 21.00 | 19.70 | 19.30 | 20.50 | 19.40 |
| 8. A.thaliana_AT4G24510.1#1_A | 20.20 | 16.30 | 20.80 | 21.70 | 19.70 | 20.50 | 19.60 | 17.10 | 20.60 | 18.90 | 23.10 | 19.90 | 18.50 |
| 9. A.thaliana_AT3G23840.1#1_A | 19.20 | 21.20 | 20.20 | 23.00 | 19.90 | 21.00 | 21.00 | 21.40 | 21.90 | 22.70 | 22.00 | 23.30 | 20.80 |
| 10. A.thaliana_AT4G13840.1#1_A | 19.10 | 18.70 | 18.80 | 21.20 | 18.80 | 20.80 | 20.00 | 19.50 | 19.70 | 18.80 | 22.40 | 21.20 | 21.30 |
| 11. G.max_Glyma08g11560.1#1_A | 20.50 | 21.80 | 20.00 | 20.00 | 20.90 | 22.70 | 21.60 | 21.10 | 23.20 | 22.20 | 23.70 | 21.90 | 20.60 |
| 12. P.trichocarpa_549793#1_A | 21.10 | 19.40 | 20.00 | 20.60 | 19.60 | 22.70 | 19.00 | 18.50 | 20.60 | 22.50 | 19.70 | 19.90 | 18.40 |
| 13. O.basilicum_TA1387_39350#1_A | 19.10 | 19.00 | 20.30 | 22.90 | 20.00 | 23.30 | 21.50 | 22.00 | 19.90 | 18.10 | 22.70 | 22.50 | 18.70 |
| 14. O.sativa_LOC_Os04g52164.1#1_A | 20.00 | 20.50 | 20.90 | 22.10 | 20.30 | 21.60 | 20.60 | 21.40 | 20.60 | 22.90 | 23.70 | 20.10 | 20.30 |
| 15. T.aestivum_TC294447#1_A | 19.40 | 19.60 | 18.90 | 18.30 | 18.90 | 19.20 | 19.70 | 21.40 | 20.30 | 22.10 | 22.60 | 20.10 | 17.80 |
| 16. A.thaliana_AT4G29250.1#1_A | 23.10 | 20.90 | 21.70 | 22.10 | 19.50 | 20.80 | 21.80 | 21.60 | 21.40 | 21.70 | 22.00 | 20.50 | 21.70 |
| 17. G.max_Glyma17g31040.1#1_A | 21.90 | 23.30 | 20.10 | 20.80 | 22.60 | 22.80 | 20.70 | 22.40 | 23.70 | 21.40 | 22.60 | 22.30 | 21.30 |
| 18. P.taeda_TA11048_3352#1_A | 22.50 | 21.70 | 23.50 | 20.10 | 21.50 | 23.30 | 19.20 | 22.50 | 24.80 | 23.70 | 25.60 | 25.40 | 21.60 |
| 19. G.max_Glyma03g40670.1#1_A | 22.60 | 20.40 | 21.90 | 23.10 | 24.80 | 21.00 | 21.70 | 22.20 | 22.40 | 22.10 | 23.60 | 24.00 | 21.60 |
| 20. Z.mays_ZM07MC26485_BFb0067H12@26407#1_A | 24.50 | 20.50 | 23.80 | 20.60 | 19.80 | 20.10 | 21.20 | 22.60 | 23.30 | 23.50 | 21.20 | 21.00 | 20.00 |
| 21. P.trichocarpa_757078#1_A | 19.00 | 20.20 | 18.50 | 20.50 | 18.70 | 18.70 | 18.70 | 19.10 | 19.70 | 19.90 | 19.30 | 18.20 | 18.30 |
| 22. Z.mays_Glossy2_X87779_#1_A | 20.70 | 22.20 | 22.50 | 23.20 | 19.00 | 20.70 | 18.60 | 21.50 | 20.60 | 21.60 | 24.40 | 22.90 | 19.10 |
| 23. A.thaliana_AT1G27620.1#1_B | 32.50 | 30.00 | 31.00 | 24.70 | 26.10 | 33.50 | 26.30 | 28.30 | 28.40 | 27.40 | 27.70 | 27.90 | 28.00 |
| 24. A.thaliana_AT2G19070.1#1_B | 29.80 | 42.30 | 29.60 | 25.20 | 35.30 | 34.80 | 32.30 | 38.50 | 57.70 | 41.80 | 38.90 | 38.60 | 36.00 |
| 25. A.thaliana_AT5G41040.1#1_B | 59.50 | 28.80 | 54.60 | 22.50 | 29.20 | 60.90 | 26.40 | 32.50 | 31.90 | 30.60 | 32.00 | 32.50 | 27.10 |
| 26. A.thaliana_AT5G48930.1#1_B | 33.60 | 41.90 | 32.40 | 26.40 | 50.80 | 37.70 | 31.50 | 75.20 | 39.30 | 35.70 | 55.20 | 50.20 | 31.50 |

FIGURE 10 (conitnued)

| | | | | | | | | | | | | |
|---|---|---|---|---|---|---|---|---|---|---|---|---|
| 27. A.thaliana_AT5G63560.1#1_B | 30.10 | 73.90 | 25.40 | 31.40 | 59.00 | 26.10 | 34.30 | 30.80 | 31.80 | 34.20 | 32.70 | 28.10 |
| 28. Aquilegia_sp_TC20397#1_B | | 30.00 | 27.40 | 34.60 | 29.20 | 36.70 | 41.20 | 47.30 | 45.50 | 39.40 | 37.30 | 36.40 |
| 29. B.napus_BN06MC25915_51267477@25820#1_B | | | 24.80 | 30.00 | 57.20 | 29.10 | 32.70 | 30.70 | 30.70 | 32.10 | 33.30 | 29.90 |
| 30. B.napus_TC72743#1_B | | | | 24.50 | 24.60 | 22.30 | 25.30 | 24.60 | 24.00 | 26.60 | 26.50 | 26.50 |
| 31. G.hirsutum_TC130878#1_B | | | | | 31.60 | 31.40 | 50.90 | 37.80 | 33.50 | 50.10 | 48.20 | 31.70 |
| 32. G.max_Glyma05g38290.1#1_B | | | | | | 27.40 | 35.20 | 32.40 | 31.40 | 33.00 | 36.60 | 29.80 |
| 33. G.max_Glyma08g42490.1#1_B | | | | | | | 32.50 | 36.80 | 53.10 | 31.20 | 32.40 | 37.30 |
| 34. G.max_Glyma13g44830.1#1_B | | | | | | | | 41.10 | 37.70 | 53.10 | 49.50 | 33.00 |
| 35. G.max_Glyma17g06860.1#1_B | | | | | | | | | 44.50 | 38.60 | 36.10 | 38.80 |
| 36. G.max_GM06MC27564_sae62b11@26939#1_B | | | | | | | | | | 35.70 | 34.50 | 40.60 |
| 37. L.sativa_TC19194#1_B | | | | | | | | | | | 50.10 | 31.00 |
| 38. M.esculenta_TA8094_3983#1_B | | | | | | | | | | 31.50 | | |
| 39. M.truncatula_AC148816_16.4#1_B | | | | | | | | | | | | |
| 40. P.trichocarpa_579978#1_B | | | | | | | | | | | | |
| 41. P.trichocarpa_587193#1_B | | | | | | | | | | | | |
| 42. P.trichocarpa_768990#1_B | | | | | | | | | | | | |
| 43. P.trichocarpa_784746#1_B | | | | | | | | | | | | |
| 44. P.trichocarpa_807676#1_B | | | | | | | | | | | | |
| 45. P.trichocarpa_810871#1_B | | | | | | | | | | | | |
| 46. P.trifoliata_TA5574_37690#1_B | | | | | | | | | | | | |
| 47. P.vulgaris_TC13456#1_B | | | | | | | | | | | | |
| 48. S.lycopersicum_TC201861#1_B | | | | | | | | | | | | |
| 49. V.vinifera_GSVIVT00017176001#1_B | | | | | | | | | | | | |
| 50. V.vinifera_GSVIVT00035108001#1_B | | | | | | | | | | | | |
| 51. S.moellendorffii_431283#1_B | | | | | | | | | | | | |
| 52. P.patens_TC44371#1_B | | | | | | | | | | | | |

FIGURE 10 (conitnued)

| | 40 | 41 | 42 | 43 | 44 | 45 | 46 | 47 | 48 | 49 | 50 | 51 | 52 |
|---|---|---|---|---|---|---|---|---|---|---|---|---|---|
| 1. M.truncatula_CU137640_9.3#1_A | 20.10 | 20.40 | 20.30 | 20.70 | 19.80 | 21.50 | 20.80 | 19.00 | 20.30 | 19.60 | 19.80 | 20.40 | 20.50 |
| 2. M.truncatula_transferase_CER2-like#1_A | 22.50 | 19.50 | 19.90 | 22.90 | 20.20 | 21.20 | 20.70 | 19.20 | 20.30 | 20.00 | 19.90 | 22.30 | 19.90 |
| 3. G.max_GM06MC00033_47170619@33#1_A | 20.90 | 21.40 | 18.10 | 21.80 | 21.10 | 21.80 | 21.70 | 21.70 | 21.80 | 19.30 | 20.80 | 22.10 | 19.00 |
| 4. G.max_Glyma02g37870.1#1_A | 21.70 | 21.80 | 17.80 | 22.50 | 20.90 | 21.80 | 21.00 | 19.90 | 22.30 | 20.10 | 20.30 | 22.50 | 20.80 |
| 5. P.trichocarpa_558994#1_A | 21.70 | 22.30 | 20.00 | 24.60 | 21.40 | 21.00 | 20.70 | 22.90 | 22.70 | 21.00 | 19.70 | 21.70 | 23.20 |
| 6. Aquilegia_sp_TC23512#1_A | 19.70 | 22.80 | 16.80 | 22.00 | 20.50 | 21.00 | 19.70 | 22.00 | 22.80 | 23.40 | 16.80 | 20.50 | 20.90 |
| 7. B.napus_BN06MC34354_BNP3363_30@34198#1_A | 20.10 | 20.10 | 17.80 | 19.30 | 20.10 | 17.50 | 19.00 | 18.50 | 23.40 | 19.10 | 16.90 | 17.60 | 20.90 |
| 8. A.thaliana_AT4G24510.1#1_A | 22.30 | 19.20 | 17.50 | 20.00 | 19.90 | 19.80 | 19.00 | 19.10 | 21.20 | 17.70 | 18.90 | 20.00 | 20.00 |
| 9. A.thaliana_AT3G23840.1#1_A | 19.30 | 20.20 | 18.90 | 21.80 | 22.10 | 22.30 | 17.90 | 18.30 | 23.10 | 21.80 | 19.40 | 20.80 | 23.70 |
| 10. A.thaliana_AT4G13840.1#1_A | 19.40 | 21.50 | 19.90 | 22.40 | 20.80 | 19.70 | 17.70 | 20.20 | 20.60 | 19.10 | 18.70 | 20.90 | 23.80 |
| 11. G.max_Glyma08g11560.1#1_A | 21.40 | 21.60 | 17.80 | 22.20 | 23.90 | 21.60 | 19.00 | 21.40 | 22.10 | 21.80 | 19.30 | 24.40 | 21.80 |
| 12. P.trichocarpa_549793#1_A | 19.60 | 20.40 | 18.70 | 20.60 | 19.70 | 19.00 | 19.10 | 19.30 | 20.20 | 17.60 | 16.80 | 20.70 | 22.40 |
| 13. O.basilicum_TA1387_39350#1_A | 20.40 | 23.80 | 20.60 | 23.20 | 20.40 | 19.70 | 17.00 | 22.90 | 22.00 | 18.80 | 20.80 | 23.30 | 21.00 |
| 14. O.sativa_LOC_Os04g52164.1#1_A | 20.30 | 21.90 | 20.40 | 20.60 | 20.50 | 20.30 | 20.00 | 19.50 | 22.50 | 19.60 | 21.60 | 23.90 | 22.50 |
| 15. T.aestivum_TC294447#1_A | 21.10 | 21.30 | 20.30 | 21.10 | 20.20 | 18.70 | 20.90 | 19.60 | 21.70 | 19.70 | 19.50 | 22.00 | 20.40 |
| 16. A.thaliana_AT4G29250.1#1_A | 21.10 | 22.00 | 21.30 | 21.70 | 22.40 | 19.70 | 18.00 | 19.90 | 22.10 | 20.60 | 21.60 | 20.00 | 21.20 |
| 17. G.max_Glyma17g31040.1#1_A | 23.40 | 23.50 | 20.50 | 23.90 | 21.40 | 22.00 | 19.50 | 22.40 | 23.70 | 21.90 | 20.30 | 21.50 | 22.50 |
| 18. P.taeda_TA11048_3352#1_A | 22.70 | 24.90 | 22.50 | 22.70 | 23.80 | 25.20 | 21.90 | 23.30 | 25.30 | 20.80 | 18.90 | 21.70 | 23.20 |
| 19. G.max_Glyma03g40670.1#1_A | 21.30 | 22.00 | 23.60 | 23.70 | 23.80 | 20.40 | 20.60 | 22.80 | 23.50 | 23.10 | 20.40 | 21.80 | 23.20 |
| 20. Z.mays_ZM07MC26485_BFb0067H12@26407#1_A | 22.20 | 22.40 | 19.20 | 22.00 | 22.80 | 23.10 | 19.50 | 24.90 | 23.10 | 22.00 | 22.00 | 22.30 | 21.60 |
| 21. P.trichocarpa_757078#1_A | 18.10 | 19.50 | 16.10 | 19.00 | 19.00 | 19.80 | 18.00 | 18.10 | 20.20 | 18.20 | 16.90 | 17.70 | 19.80 |
| 22. Z.mays_Glossy2_X88779_#1_A | 17.60 | 21.50 | 19.10 | 21.40 | 20.70 | 20.80 | 19.70 | 19.50 | 23.20 | 19.80 | 18.00 | 22.90 | 23.60 |
| 23. A.thaliana_AT1G27620.1#1_B | 24.90 | 27.10 | 25.10 | 25.30 | 26.80 | 26.40 | 24.00 | 26.60 | 29.10 | 24.50 | 24.40 | 21.80 | 24.70 |
| 24. A.thaliana_AT2G19070.1#1_B | 23.60 | 39.80 | 24.60 | 38.80 | 31.60 | 62.40 | 23.10 | 35.70 | 37.90 | 47.40 | 23.20 | 23.90 | 30.90 |
| 25. A.thaliana_AT5G41040.1#1_B | 21.50 | 34.30 | 22.60 | 31.40 | 44.80 | 31.10 | 22.50 | 28.80 | 33.80 | 29.70 | 25.50 | 24.40 | 27.90 |
| 26. A.thaliana_AT5G48930.1#1_B | 24.00 | 81.30 | 26.00 | 53.90 | 31.90 | 40.80 | 24.00 | 60.00 | 56.60 | 41.00 | 21.30 | 28.40 | 35.50 |

FIGURE 10 (conitnued)

| | | | | | | | | | | | | | |
|---|---|---|---|---|---|---|---|---|---|---|---|---|---|
| 27. A.thaliana_AT5G63560.1#1_B | 24.50 | 34.20 | 22.90 | 31.90 | 43.80 | 32.10 | 24.90 | 32.70 | 35.70 | 28.60 | 25.20 | 23.00 | 29.90 |
| 28. Aquilegia_sp_TC20397#1_B | 24.50 | 43.00 | 26.10 | 39.10 | 27.30 | 44.60 | 25.80 | 37.90 | 39.50 | 47.30 | 22.20 | 22.70 | 30.50 |
| 29. B.napus_BN06MC25915_51267477@25820#1_B | 22.50 | 32.60 | 23.10 | 31.60 | 41.10 | 30.10 | 24.70 | 31.00 | 32.70 | 29.60 | 24.20 | 23.70 | 29.10 |
| 30. B.napus_TC72743#1_B | 32.70 | 25.70 | 38.80 | 25.60 | 25.80 | 24.20 | 34.60 | 25.70 | 27.30 | 25.20 | 33.80 | 21.40 | 24.50 |
| 31. G.hirsutum_TC130878#1_B | 22.70 | 51.70 | 24.60 | 51.50 | 30.70 | 36.50 | 22.50 | 49.40 | 51.30 | 35.30 | 23.10 | 24.00 | 31.90 |
| 32. G.max_Glyma05g38290.1#1_B | 24.70 | 37.80 | 24.60 | 35.10 | 45.50 | 31.10 | 24.70 | 32.10 | 36.30 | 27.90 | 23.70 | 27.30 | 31.00 |
| 33. G.max_Glyma08g42490.1#1_B | 24.90 | 32.50 | 24.50 | 33.50 | 25.20 | 35.60 | 25.90 | 31.70 | 32.20 | 37.60 | 20.90 | 24.50 | 26.10 |
| 34. G.max_Glyma13g44830.1#1_B | 24.30 | 78.40 | 25.10 | 53.10 | 32.20 | 41.20 | 23.10 | 64.50 | 55.20 | 41.60 | 21.80 | 29.50 | 35.10 |
| 35. G.max_Glyma17g06860.1#1_B | 24.20 | 40.90 | 24.40 | 39.70 | 29.40 | 63.00 | 26.20 | 37.60 | 36.60 | 51.30 | 24.50 | 24.70 | 30.30 |
| 36. G.max_GM06MC27564_sae62b11@26939#1_B | 25.50 | 37.70 | 28.00 | 38.30 | 27.70 | 42.50 | 23.00 | 34.00 | 34.30 | 44.00 | 23.10 | 24.50 | 30.30 |
| 37. L.sativa_TC19194#1_B | 23.30 | 57.10 | 25.60 | 52.00 | 32.20 | 41.20 | 24.70 | 51.30 | 69.20 | 36.20 | 24.00 | 25.50 | 34.50 |
| 38. M.esculenta_TA8094_3983#1_B | 22.40 | 52.10 | 26.60 | 49.40 | 33.30 | 38.10 | 25.00 | 45.70 | 51.30 | 35.70 | 26.10 | 25.30 | 33.30 |
| 39. M.truncatula_AC148816_16.4#1_B | 25.20 | 31.30 | 24.60 | 33.50 | 26.10 | 38.20 | 26.00 | 30.80 | 31.40 | 39.30 | 24.40 | 24.00 | 28.10 |
| 40. P.trichocarpa_579978#1_B | | 23.10 | 36.10 | 22.80 | 23.70 | 25.10 | 30.20 | 25.10 | 24.10 | 23.10 | 32.40 | 24.20 | 24.40 |
| 41. P.trichocarpa_587193#1_B | | | 25.70 | 55.00 | 32.50 | 41.80 | 22.70 | 61.30 | 58.70 | 41.50 | 22.50 | 27.60 | 34.10 |
| 42. P.trichocarpa_768990#1_B | | | | 25.00 | 24.00 | 23.70 | 33.90 | 24.90 | 26.10 | 24.70 | 36.60 | 19.70 | 22.70 |
| 43. P.trichocarpa_784746#1_B | | | | | 30.30 | 41.30 | 24.90 | 50.00 | 52.90 | 36.00 | 22.90 | 24.70 | 35.40 |
| 44. P.trichocarpa_807676#1_B | | | | | | 29.20 | 23.50 | 32.30 | 33.80 | 26.70 | 24.10 | 24.60 | 26.30 |
| 45. P.trichocarpa_810871#1_B | | | | | | | 25.10 | 38.10 | 40.40 | 49.40 | 22.00 | 24.80 | 32.60 |
| 46. P.trifoliata_TA5574_37690#1_B | | | | | | | | 23.80 | 24.80 | 25.90 | 31.50 | 21.90 | 24.70 |
| 47. P.vulgaris_TC13456#1_B | | | | | | | | | 51.70 | 34.10 | 23.50 | 27.20 | 31.80 |
| 48. S.lycopersicum_TC201861#1_B | | | | | | | | | | 35.90 | 23.90 | 25.90 | 32.30 |
| 49. V.vinifera_GSVIVT00017176001_B | | | | | | | | | | | 22.80 | 25.70 | 29.50 |
| 50. V.vinifera_GSVIVT00035108001#1_B | | | | | | | | | | | | 22.70 | 22.00 |
| 51. S.moellendorffii_431283#1_B | | | | | | | | | | | | | 24.30 |
| 52. P.patens_TC44371#1_B | | | | | | | | | | | | | |

FIGURE 10 (conitnued)

```
MEIPVINRISDFETGLASLQNPTFLSQILALSGVEKIHQAYSFWKWGALILALAASFTAIINRIKI
---Motif 2--                             ----Motif 1----
--------Motif 6------    ---------------------Motif 4-------------

LIIRFKNHPFISSPSLISNQEDCDYESETDLSCSSSISLSDDEQEEESTSSSRSWWSINDHDQDFR
---------

VRGSGNRYIDDQCQGGNFRLRRRRNSSIGDFFSLTDFTNGKNVVKLWDNLGLSLGLNLNNSCDSRN
                                                --Motif 3--
                                         ------Motif 5----

AAVSFYDINKEQKICSIFGSTCDSIFAAVSTSPSVVVSAETNLSGHSSLSLWDTRVGFRVPEVFAE

LRPTLGKIVGVVVGGVEKVYVRDDVTGELTVGDMRKPSSPLVNVTESDVDTWWDADAVIVENECEK

```
                                        1                                      50
A.lyrata_475964#1               MEVPV..INRIRDFEVGINSI.NDPSF..LSRSV..AVSGIGKLHQAYGF
A.thaliana_AT1G68440.1#1        MEVPV..INRIRDFEVGINSI.NDPSF..LSRSV..AVSGIGKLHQAYGF
A.lyrata_921679#1               MEVPI..INRISDFDVGINSI.NDPSY..LSRAL..AVSGVGKLHQAYSF
A.thaliana_AT1G25400.1#1        MEVPI..INRISDFDMGINSI.NDPSY..LSRAL..AVSGVGKLHQAYSF
C.clementina_DY272345#1         MEILV..VNRIIDFETNI.....NPSL..VSQVS..AVSGIGKFYQTYNL
C.clementina_TC10465#1          MEILV..VNRIIDFETNI.....NPSL..VSQVS..AVSGIGKFYQTYNL
C.clementina_TC31598#1          MEILV..VHRIIDFQTNI.....NPSL..VSQVS..AVSGIGKFYQTYHL
C.clementina_TC18948#1          MEILV..VNRIIDFETNI.....NPSL..VSQVS..AVSGIGKFYQTYNL
P.trifoliata_TA5851_37690#1     MEILV..VNRIIDFETNI.....NPSL..VSQVS..AVSGIGKFYQTYNL
P.trichocarpa_769638#1          MEIPV..INRISDFETGISSL.QNPSF..LSQIL..ALSGAEKIHQAYSF
P.trichocarpa_832731#1          MEIPV..INRISDFETGLASL.QNPTF..LSQIL..ALSGVEKIHQAYSF
Pt putative MP dehydrogenase    MEIPV..INRISDFETGLASL.QNPTF..LSQIL..ALSGVEKIHQAYSF
R.communis_TA1965_3988#1        MEIPV..INRIGDFEASL....QNPSF..LSQAI..TLSGVEKIHQAYGF
G.hirsutum_TC134197#1           MEIPV..INRISDFEASISTL.NNPSF..LSQVY..ALSGIDKIYQAYHF
M.domestica_TC34673#1           MEIPV..LNRITDLPSRLTSL.PDPSF..LSQSL..SIPGIQNVSQAYSF
G.max_Glyma10g41960.1#1         MLLLL..................LT.............LPSF
G.max_TC278929#1                MQVPL..IDRINDLQVGLNSL.QNPSF..PSQIT.........TSLAYNF
G.max_TC339602#1                MQVPLIDIDRINDLQVGLNSL.QNPSFPIPSQIT.........TSLAYNF
P.vulgaris_TC13663#1            MQVPL..IDRLNDLQVGLNSL.QNPSF..PSQIT....TSLASVSIAYNF
L.japonicus_TC42314#1           MQVPL..IDRLNDLQVGFNSL.QNPSF..PSPIT.SSLAGIQSVSVVYNF
M.truncatula_AC135604_14.4#1    MQVPL..IDRLNDFQAGFNSLQQNPSF..PSQITATSFNGIQSVSIAFNF
V.vinifera_GSVIVT00030351001#1  MEIPI..INRMSNF........DDPSV..LSRLF..PIS...QISQPFSL
H.paradoxus_TA2948_73304#1      MEIAE..LNLIGDFEAGIKCL.QNPSL..LSNLS..........LHKYSF
H.petiolaris_DY945986#1         MEIAE..LNLIGDFEAGIKCL.QNPSL..LSNLS..........LHKYSF
L.saligna_DW067807#1            MEITE..LNLIGDFEAGMKCL.QNPSL..LSTVS.....LIDKVPRFYSY
L.serriola_TC6013#1             MEITE..LNLIGDFEAGMKCL.QNPSL..LSTVS.....LIDKVPRFYSY
L.virosa_DW158350#1             MEITE..LNLIGDFEAGMKCL.QNPSL..LSTVS.....LIDKVPRFYSY
L.sativa_TC23070#1              MEITE..LNLIGDFEAGMKCL.QNPSL..LSTVS.....LIDKVPRFYSY
T.officinale_TA2631_50225#1     MEITE..LNLIGDFEAGMKCL.QNPSL..LSKVS.....LIDKVPRFYSF
N.tabacum_TC41632#1             MDFTE..INMISDFEAGVKCL.QNPSL..ISRFF..SLS...EVTQIYSF
S.lycopersicum_TC193481#1       MEFPE..INMISDFEAGVKCL.QNPSM..VSRFF..SLSPIEKVPQVYSF
O.basilicum_TA1347_39350#1      MEIPE..INMLSDFEAGMKCL.QNPSF..ISRLS..SFP.........TF
T.versicolor_TC2688#1           MEITE..LNMISDFQAGIKCL.QSPSL..ISRFF..SF.......QVYSF
Aquilegia_sp_TC24194#1          MEIPV..ISRISSFEA.......NPSF..ISRVL..HLTSIENTIKVHTF
Aquilegia_sp_TC25879#1          MEIPV..ICRISSFEA.......NPSF..ISRVL..HLTSIENTIKVHAF
```

FIGURE 13

```
                                         51                                            100
A.lyrata_475964#1                        WKWGA.LIIAFLAYFTNFVSK.LNSLVVRLIKI..DVSVSSPTLFD....
A.thaliana_AT1G68440.1#1                 WKWGA.LIIAFLAYFTNFVSK.LNSLVVRLRKI..DVSVSSPTLFD....
A.lyrata_921679#1                        WKWGALLLLAFFASFTSLTTR.IKALVFRLRNV..NVSLPSPTLLC....
A.thaliana_AT1G25400.1#1                 WKWGALLLLAFFASFTSLTTR.IKTLVFRLRNV..NVSLPSQTLLC....
C.clementina_DY272345#1                  WKWGA.LILALIASFTTIINR.VKALIVKLQKH..PSLSSSQHEQL...L
C.clementina_TC10465#1                   WKWGA.LILALIASFTTIINR.VKALIVKLQKH..PSLSSSQHEQL...L
C.clementina_TC31598#1                   WKWGA.LILALIASFTTIINR.VKALIVKLQKH..PSLSSSQHEQL...L
C.clementina_TC18948#1                   WKWGA.LILALIASFTTIINR.VKALIVKLQKH..PSLSSSQHEQL...L
P.trifoliata_TA5851_37690#1              WKWGA.LILALIASFTTIINR.VKALIVKLQKH..PSLSSSQHEQL...L
P.trichocarpa_769638#1                   WKWGA.LLLALVASFTTIINR.IKILVIRFKNH..PFISSPSLITN...Q
P.trichocarpa_832731#1                   WKWGA.LILALAASFTAIINR.IKILIIRFKNH..PFISSPSLISN...Q
Pt_putative_MP_dehydrogenase             WKWGA.LILALAASFTAIINR.IKILIIRFKNH..PFISSPSLISN...Q
R.communis_TA1965_3988#1                 WKWGA.LILALVASFSTIINR.IKNLIIRIQNHYLTPSPPPPLTTQ...Q
G.hirsutum_TC134197#1                    WKWGA.LILALLASLSTIINR.LKILVIRFRRN..HSLPSRPLLY.....
M.domestica_TC34673#1                    WKWGA.LILAILASFGTLITK.INIFAISLRRL..RLLAPQPLSQQ...R
G.max_Glyma10g41960.1#1                  CKWGL.FFLTLL.........LTAFIFRLRQN..APPFPLIIATY....
G.max_TC278929#1                         CKWGA.VILALVATFGSIINR.VTIFIIRFRAK..APSLPSLNLN.....
G.max_TC339602#1                         CKWGA.VILALVATFGSIINR.VTIFIIRFRAK..APSLPSLTLN.....
P.vulgaris_TC13663#1                     CKWGA.VILALVATFGSIINR.VTIFILRFRTK..APSLPSNDEY.....
L.japonicus_TC42314#1                    CKWGA.VFLALVATFSSIINR.VTVFIIRFRSK..PESLPSISLF.....
M.truncatula_AC135604_14.4#1             CKWGA.VILALVATFTSLINK.VTIFIIHLRKK..ASSLPSITFDN....
V.vinifera_GSVIVT00003035100I#1          WKWGA.LILALLATFTSIINR.TKILIIRLRKR..SSLAAQPLHSE...P
H.paradoxus_TA2948_73304#1               WTCGA.LIIAVFATFTNLFNK.INLFIHQIRFRFLSSFQTSSPQQIQFDD
H.petiolaris_DY945986#1                  WTCGA.LIIAVFATFTNLFNK.INLFIHQIRFRFLSSFQTSSPQQIQFDD
L.saligna_DW067807#1                     WTWGA.LILAVFATFTSVFNR.IKLFIYQIRLKLLASCQKSCPQQI.FGD
L.serriola_TC6013#1                      WTWGA.LILAVFATFTSVFNR.IKLFIYQIRLKLLTSCQKSCPQQI.FGD
L.virosa_DW158350#1                      WTWGA.LILAVFATFTSVFNR.IKLFIYQIRLKLLTSCQKSCPQQI.FGD
L.sativa_TC23070#1                       WTWGA.LILAVFATFTSVFNR.IKLFIYQIRLKLLTSCQKSCPQQI.FGD
T.officinale_TA2631_50225#1              LTWGA.LILAVFATFTSVFNR.IKLFIYQIRLKILASCQKSCPQQI.FGD
N.tabacum_TC41632#1                      WKWGA.LILAVVATFSSLIRK.IKLLFIYVFTL..KPSAEPLLQYL....
S.lycopersicum_TC19348I#1                WKWGA.LILAILATFSSLIRK.IKLLFIYVRRI..KPSAEPLLQYL....
O.basilicum_TA1347_39350#1               WKWGA.LIFAIFATFSSVIRR.IKLILRFHTV..KSPSNPT........
T.versicolor_TC2688#1                    CKWGA.LIFAIFATFSSLIRR.IKLVLIRLHTV..KDSSIKK........
Aquilegia_sp_TC24194#1                   WTLGA.LIIAIFATFSCVITRNINLIIFRFQKG..KSVISQPLLQQLCED
Aquilegia_sp_TC25879#1                   WTLGA.LIIAIFATFSSVITRNINLIIFRFQKG..KSVISQPLLQQLCED
```

FIGURE 13 (continued)

```
                                        101                                      150
A.lyrata_475964#1                       ....DYDSDSD....VSCSS.....TVSSDDEEDEEDE..DDDEDEDVDS
A.thaliana_AT1G68440.1#1                ....DYDSDSD....VSCSS.....TVSSDDEKDEEDE..ADDEDEDVDS
A.lyrata_921679#1                       ....NYDSDSD....WSFAS......DSSDE..DDDDD..KED.......
A.thaliana_AT1G25400.1#1                ....NYDSDSD....WSFSS......DSSDEEKDEDDN..KED.......
C.clementina_DY272345#1                 D.DDDCETDSISSDDEDEQER....DGDGDEEEEEEEE..ESGTTPFYTS
C.clementina_TC10465#1                  D.DDDCETDSISSDDEDEQER....DGDGDEEEEEEEE..ESGTTPFYTS
C.clementina_TC31598#1                  D.DDDCETDSISSDDEDEQER....DGDGDEEEEEEEE..ESGTTPFYTS
C.clementina_TC18948#1                  D.DDDYETDSISSDDEDEQERDGDGDGDGDEEEDEEEE..ESGTTPFYTS
P.trifoliata_TA5851_37690#1             D.DDDYETDSISSDDEDEQER....GGDGDEEEDEEEE..ESGTTPFYTS
P.trichocarpa_769638#1                  E.DGDYESETD....LSCSSS....ISLSDEEQEEEPP..STSRSWWS..
P.trichocarpa_832731#1                  E.DCDYESETD....LSCSSS....ISLSDDEQEEEST..SSSRSWWS..
Pt_putative_MP_dehydrogenase            E.DCDYESETD....LSCSSS....ISLSDDEQEEEST..SSSRSWWS..
R.communis_TA1965_3988#1                HYDSDTESETS....SSSSSDDEQDIEVEDDEEDEDER..CSWRS.....
G.hirsutum_TC134197#1                   ..DTDFDTDSET...SSCSS.......SDNEVEYEEP..SASQSW....
M.domestica_TC34673#1                   H.DGDYSDVSDDDDICSVSSA....SSVSDDESESEIS..YDDESR....
G.max_Glyma10g41960.1#1                 ....DYSDTDDDDGISSTSE.....FEDDDDEEEENEE............
G.max_TC278929#1                        ..DDDFYTSSDDEDDFQ.NDEDDDLTYSSSE..PEDEP..SASSSF....
G.max_TC339602#1                        ..DDNFYTSSSSDDDDD.DDNDDDLTYSSSE..PEDEP..SASSSF....
P.vulgaris_TC13663#1                    ...DDVYSSTDDDDD...YENDDDLTYLSSD..LEDEP..SASSSF....
L.japonicus_TC42314#1                   ..DDDFSDISSDDGDVDDLEDDDDTGNDSSSE.FDDEPSASASSSF....
M.truncatula_AC135604_14.4#1            ..DDDFSSDDED......NENDDIVSLSSSSEFEDDEP..SMSSS.....
V.vinifera_GSVIVT00030351001#1          D.DGGFSDSED....DTCSS......ISSDDDDDAEPM............
H.paradoxus_TA2948_73304#1              D.DFDFDFSDDDIDDDTPSS.....VAESDDEDYDSED............
H.petiolaris_DY945986#1                 D.DFDFDFSDDDIDDDTPSS.....VAESDDEDYDSED............
L.saligna_DW067807#1                    D.DLDLDFSDDDGDDDTPSS.....VAESDDEELDSED............
L.serriola_TC6013#1                     D.DLDFDFSDDDGDDDTPSS.....VAESDDEELDSED............
L.virosa_DW158350#1                     D.DLDFDFSDDDGDDDTPSS.....VAESDDEELDSED............
L.sativa_TC23070#1                      D.DLDFDFSDDDGDDDTPSS.....VAESDDEELDSED............
T.officinale_TA2631_50225#1             D.DFDFDSSDDDGDDDTPSS.....VAESDDEELDSED............
N.tabacum_TC41632#1                     ..GEDFDISESDDEDDKCSI.....PPSSDDEDLID..............
S.lycopersicum_TC193481#1               ..GEDFDISDDDDEDDKCSSAA...APSSDDEDLLD..............
O.basilicum_TA1347_39350#1              ..VDAFEFSDD....EDNVVS.....PASSDDDRGGEEE..EDRPTTSFSG
T.versicolor_TC2688#1                   ..DEIFEFSDDD..DDDDIS.....LASSDDEDEQEER..ESRQTTSFRG
Aquilegia_sp_TC24194#1                  DDDDDSEVEEEDYEEETCSSV.......SDDEDDATYD...NNE......
Aquilegia_sp_TC25879#1                  DDDDDSEVEEEDYEEETCSSVS...SLSSDDEDDATYD..NNNE......
```

FIGURE 13 (continued)

```
                                      151                                          200
A.lyrata_475964#1                     IFNRRRVNG.GFRVRGSDYY..DDDDDQGENGNCTWMGRRCSGSIGD.LF
A.thaliana_AT1G68440.1#1              IFNRRRVNG.GFRVRGSDYY..DDDDDQGDNGNCTWMGRRYSGSFGD.LF
A.lyrata_921679#1                     ....ESVNG.DLRVKRFSYF..HDDDDKAINGNVPWL.RRCSGSFGD.LL
A.thaliana_AT1G25400.1#1              ....DSVNG.DSRVQRFGYY..HDDDDKGISGSVPWL.RRCSGSFGD.LL
C.clementina_DY272345#1               RNWQRHVDE.DFRVRGSGDV..CDDDEQWKNRNLGL..RRRRRNIGD.LF
C.clementina_TC10465#1                RNWQRHVDE.DFRVRGSGDV..CDDDEQWKNRNLGL..RRRRRNIGD.LF
C.clementina_TC31598#1                RNWQRHVDE.DFRVRGSGDV..CDDDEQWKNRNLGL..RRRRRNIGD.LF
C.clementina_TC18948#1                RNWQRHVDE.DFRVRGSGDV..YDDDEQWQNRNLGL..RRRRRNIGD.LF
P.trifoliata_TA5851_37690#1           RNWQRHVDE.DFRVRGSGDV..YDDDEQWQNRNLGL..RRRRRNIGD.LF
P.trichocarpa_769638#1                ...INDHDE.DFCVRGSGN...RYIDDQWQGNFRLR.RRRNSSIGD.FF
P.trichocarpa_832731#1                ...INDHDQ.DFRVRGSGN...RYIDDQCQGGNFRLR.RRRNSSIGD.FF
Pt_putative_MP_dehydrogenase          ...INDHDQ.DFRVRGSGN...RYIDDQCQGGNFRLR.RRRNSSIGD.FF
R.communis_TA1965_3988#1              ....NDDDDYYSVVKGSG....HYIDDQWQNRNLR...RRRNSSLQD.LF
G.hirsutum_TC134197#1                 ....RQVDE.DFRVRGSG....HFIDDQWRNSGSTL.RKRRSSIGD.LF
M.domestica_TC34673#1                 ...TIGRDE.HFHVRGSG....YYGDDGEQNRNLG...LRLRRSFGGHRF
G.max_Glyma10g41960.1#1               ....DRRDE.YFRVRGSTN..................DERRRSIAD.FL
G.max_TC278929#1                      ....IRLED.YFRIRGTD.....NLDDEFQTQNGT...HKRCRSIGD.IF
G.max_TC339602#1                      ....IRLDD.YFRLRGTDNNNNNNLDDEFQTQNGT...HKRCRSIGD.IF
P.vulgaris_TC13663#1                  ....IRLED.YFRLRGTPDND.HNQNDDFQTQNGT...HKRCRSIGD.IF
L.japonicus_TC42314#1                 ....LRLDDFFFRVRGTAQN.....DESSRSQIDT...RHRSCSIGD.IF
M.truncatula_AC135604_14.4#1          ....SSFKD.FFRLTGNSND..YDVNNVFQTQNSG...HRRQHSIGD.FF
V.vinifera_GSVIVT00003035001#1        ....SLIED.DKNVRVG......YCEDEPQSHKTK..LRRCRSIGD.RL
H.paradoxus_TA2948_73304#1            ....TCVNE.VFRVEGSGSC..YFDDNEGQEGNFTL.RRRN......RF
H.petiolaris_DY945986#1               ....TRVNE.VFRVEGSGSS..YFDDNEGQEGNFTL.RRRN......RF
L.saligna_DW067807#1                  ....GHPDE.VFRAEGSS....FWGNNRGSDGNFTL.RRRN......GF
L.serriola_TC6013#1                   ....GHPDE.VFRAEGSS....FWGNNRGSDGNFTL.RRRN......GF
L.virosa_DW158350#1                   ....GHPDE.VFRAEGSS....FWGNNRGSDGNFTL.RRRN......GS
L.sativa_TC23070#1                    ....GHPDE.VFRAEGSS....FWGNNRGSDGNFTL.RRRN......GL
T.officinale_TA2631_50225#1           ....GHADE.VFRAEGSS....FWGNNRGPDGNFTL.RRRN......GF
N.tabacum_TC41632#1                   ....RQIDE.DFRVSGSS....FYFKEQGQNCNLR..LRRQRNSFE.RF
S.lycopersicum_TC193481#1             ....QQIDE.DFTVAGSC....FYFREK...GNLR..FRRRRNSLE.RF
O.basilicum_TA1347_39350#1            ...QHRVDE.NFCVRGSI....HSFKTQGQNGQLR..QRRRRSCGN...
T.versicolor_TC2688#1                 ...QHRVGQ.DSRVKG...........WSTGRLR...QRRQRSCGG...
Aquilegia_sp_TC24194#1                ...RRRFDE.DFRVAGSG....KFEEIRGRKGKLKL..SRRNSSNGEFIF
Aquilegia_sp_TC25879#1                ...RRRFDE.DFRVAGSG....KFEEIRGRKGKLKL..SRRNSSNGEFIF
```

FIGURE 13 (continued)

```
                                      201                                               250
A.lyrata_475964#1                     SWP.DLGGIGSSGVVKLWDELDI.........DGDDDDHENVVATFLKNC
A.thaliana_AT1G68440.1#1              SWP.DLGGIGSSGVVKLWDELDI.........DG..DDHENVVATFLKNY
A.lyrata_921679#1                     D.......LGSSGVVKLWDNLDF.........NGEGSEHN.AVASFLSKC
A.thaliana_AT1G25400.1#1              D.......LGSSGVVKLWDNLDF.........NGEGS....PVASFFSKC
C.clementina_DY272345#1               SWS.ELMMTSGKNVVKLWDNLGLGLGLNL...ED..YSEN.EFTIYDMNY
C.clementina_TC10465#1                SWS.ELMMTSGKNVVKLWDNLGLGLGLNL...ED..YSEN.EFTIYDMNY
C.clementina_TC31598#1                SWS.ELMMTSGKNVVKLWDNLGLGLGLNL...ED..YSEN.EFTIYDMNY
C.clementina_TC18948#1                SWS.ELMMTSGKNVVKLWDNLGLGLGLNL...ED..YSEN.EFTIYDMNY
P.trifoliata_TA5851_37690#1           SWS.ELMMTSGKNVVKLWDNLGLGLGLNL...ED..YSEN.EFTMYDMNY
P.trichocarpa_769638#1                SLS.DF..TNERNVVKLWDNLGLGLGFNL...NNGGDSRSAVVSFYDINN
P.trichocarpa_832731#1                SLT.DF..TNGKNVVKLWDNLGL...........................
Pt_putative_MP_dehydrogenase          SLT.DF..TNGKNVVKLWDNLGLSLGLNL...NNSCDSRNAAVSFYDINK
R.communis_TA1965_3988#1              S...EF..RNGKSVVKLWDNLGFGFGLNL...DN..NSRN.CVSLHDINK
G.hirsutum_TC134197#1                 SWAEEL..TSGKSVVKLWDNLGLGFRLDL...DE...SDN.VLNVYDINK
M.domestica_TC34673#1                 SWS.DF..AAGKSVVKLWDS..............................
G.max_Glyma10g41960.1#1               SLS.EI..ANTKSVVKLWDTIGFGLGFGFEEVDDRSSDGSRIVSVYD...
G.max_TC278929#1                      SLS.EL..ANSKSVVKLWDSIGFGLGLDF...DD..YDGY.EVSSAKPLQ
G.max_TC339602#1                      SLS.EL..ANSKSVVKLWDTIGFGLGLDF...DD..YDGY.YVGNA...A
P.vulgaris_TC13663#1                  SLS.EL..ANSKSVVKLWDSIGFGLGLDF...DD..YEDG.VVSTYD...
L.japonicus_TC42314#1                 SLA.EL..ASSDSVVKLWDTIGFGLGLDF...DD..YEES.PLHAP....
M.truncatula_AC135604_14.4#1          SLL.EL..ANGDNVVKLWDSIGFGLGLDF...DE..YEDG.VISSTNPEA
V.vinifera_GSVIVT00030351001#1        FLS.EL..TNGKSIVKLWDGLSL.........DN..SCGS.LVSIYDLNK
H.paradoxus_TA29487_3304#1            SWS.DF..SAGKSVVQLWDSFGLGLDFED...DD..DESG..IAIWDLNR
H.petiolaris_DY945986#1               SWS.DF..SAGKSVVQLWDSFGLGLDFED...DD..DESG..IAIWDLNR
L.saligna_DW067807#1                  SLS.DF..SAGKSVVQL.DSFGLGLDFED...DE..SEYGSEIAIWDLDR
L.serriola_TC6013#1                   SLS.DF..SAGKSVVQLWDSFGLGLDFED...DE..SEYGSEIAIWDLDR
L.virosa_DW158350#1                   SLS.DF..SAGKSVVQLWDSFGLGLDFED...DE..SEYGSEIAIWDLDR
L.sativa_TC23070#1                    SLS.DF..SAGKSVVQLWDSFGLGLDFED...DE..SEYGSEIAIWDLDR
T.officinale_TA2631_50225#1           SLS.DF..TAGKSVVQLWDSFGLGLDFED...DE..SDYGSEIAIWDLDR
N.tabacum_TC41632#1                   PWT.EF..SAGKNVVKLWDSLALGLDYEY...DD..LSKS.VVSLWDLNA
S.lycopersicum_TC193481#1             PWT.EF..SAGKNVVKLWDSLALGLDYEY...ED..LSNS.VVSLWDLNQ
O.basilicum_TA1347_39350#1            AWS.GF..ASGKNVVKLWDSLGFSLDIDE...DLFNYDPKSVVSTWDHYQ
T.versicolor_TC2688#1                 AWS.DF..APGKSVVKLWDSLGLSLDFDE...DLFNFGGQSVVSTWDYDR
Aquilegia_sp_TC24194#1                SWS.DL..VNGKSVVKSWDGLGLGFGLEK.......ASES.LITLWELNK
Aquilegia_sp_TC25879#1                SWS.DL..VNGKSVVKSWDGLGLGFGLEK.......ASES.LITLWELNK
```

FIGURE 13 (continued)

```
                                       251                                               300
A.lyrata_475964#1                    S....................STSS.LFLAAEKKGVD.AVKVKACDPR
A.thaliana_AT1G68440.1#1             N....................STSSPFFWAAEKKGVD.AVKVKACDPR
A.lyrata_921679#1                    G....................SYSLLSSTVLLAAEKKGSD.GLEVSAWDAR
A.thaliana_AT1G25400.1#1             G....................SYSLLSSAVLLAAEKKGSD.GLEVSAWDAR
C.clementina_DY272345#1              EREFRKIASIFGRKDESPAFVSASSSPAVIVSAAISGSG.RVALGGWDTR
C.clementina_TC10465#1               EREFRKIASIFGRKDESPAFVSASSSPAVIVSAAISGSG.RVALGGWDTR
C.clementina_TC31598#1               EREFRKIASIFGRKDESPAFVSASSFR......................
C.clementina_TC18948#1               EREFRKIASIFGRKDESPAFVSASSSPAVIVSAATSGSG.RVALGGWDTR
P.trifoliata_TA5851_37690#1          EREFRKIASIFGRKDESPAFVSASSSPAVIVSAARRGSG.RVALGGWDTR
P.trichocarpa_769638#1               E...RNICSIFGSKCD........................SFTAVSPR
P.trichocarpa_832731#1               ............................KTNLSG.HSSLSLWDTR
Pt_putative_MP_dehydrogenase         E...QKICSIFGSTCD.SIFAAVSTSPSVVVSAEINLSG.HSSLSLWDTR
R.communis_TA1965_3988#1             E...LSLFSILGERSDIPAVSTSSSSPAVIVSSEANVAG.NL.LKVWDTR
G.hirsutum_TC134197#1                E...TKIKSIFGEKSDFQAVSASSSSPAVVVSTGGDSSTRRVAVSAWDTR
M.domestica_TC34673#1                .....................SSPSIFLSADSGVSG.RVSLGVWDAR
G.max_Glyma10g41960.1#1              ....................GELPDPAVVVSAGENASG.NLAVTIWDTR
G.max_TC278929#1                     A...............PTSSTASPAVVVSAGEGAYG.NLALEIWDTR
G.max_TC339602#1                     V...............PTSSTASPSVVVSAGEGACG.NLALEIWDTR
P.vulgaris_TC13663#1                 ..................PANSTASPAVLVSAGEGACG.NLAVEVWDTR
L.japonicus_TC42314#1                ..................ASSSTASPAVVVSAAEGSRG.NLEVGIWDTR
M.truncatula_AC135604_14.4#1         P...............LTSAAASPDVIVSAGEGAHG.NLAVEIWDTR
V.vinifera_GSVIVT00030351001#1       D...LNKSSFFGGTHRFP..SVSVTSPAVVVSTMIGNAM.NTALRVWDTR
H.paradoxus_TA2948_73304#1           D...VKLSS..GRRCQVP....ASVAEKVVLTAEMDGSHGGVGFGIYDSR
H.petiolaris_DY945986#1              D...VKLSS..GRRCQVP....ASVAEKVVLTAEMDGSHGGVGFGIYDSR
L.saligna_DW067807#1                 D...VKLSS..GRRCEV.....AAVADNVVLTAEMNGNNGEVGFRIYDSR
L.serriola_TC6013#1                  D...VKLSS..GRRCEV.....AAVADNVVLTAEMNDNNGEVGFRIYDSR
L.virosa_DW158350#1                  D...VKLSS..GRRCEV.....AAVADNVVLTAEMNDNNGEVGFRIYDSR
L.sativa_TC23070#1                   D...VKLSS..RRRCEV.....AAVADNVVLTAEMNDNNGEVGFRIYNSR
T.officinale_TA2631_50225#1          D...VKLSS..GRRCKV.....AAASDNVVLTAEMNESNGGVGFSIYDSR
N.tabacum_TC41632#1                  E...QKISDIFSGSSQFQ................................
S.lycopersicum_TC193481#1            E...EKIGNLFIGSSKVP..SVAMASPSYVLSSEVKNDRNGVVLAAYDTR
O.basilicum_TA1347_39350#1           E...QNPTNFSGGVW.....GASAAAPTVLLTAEGNGKGDGVILGGYDTR
T.versicolor_TC2688#1                D...LKKNDFFGGDWDIP.....AASAIVVFTAESNRKGEGVVLGGFDTR
Aquilegia_sp_TC24194#1               N...EITNSFSGGLCHIP..ALSMPSPAVIVSAGLETSR.SMALRVFDNR
Aquilegia_sp_TC25879#1               N...EITNSFSGGLCHIP..ALSMPSPAVIVSAGLETSR.SMALRVFDNR
```

FIGURE 13 (continued)

```
                                              301                                              350
A.lyrata_475964#1                 AGFKMPALLAEWRQPGRLLGNIIGVD...AGGVEKVYVRDDV...SGEIA
A.thaliana_AT1G68440.1#1          AGFRMPALLAEWRQPGRLLGNIIGVD...TGGVEKVYVRDDV...SGEIA
A.lyrata_921679#1                 VGFGVPALLAEWKQPGRLLGKIIRVD...VGDVDKIYVGDDV...GGEIT
A.thaliana_AT1G25400.1#1          VGFGVPALLAEWKQPGRLLGKIIRVD...VGDVDKIYVGDDV...EGEIT
C.clementina_DY272345#1           IGSRIAAMLAEWRP...KLGNIVGIR...AGRIEKVLVRESV...INAFT
C.clementina_TC10465#1            IGSRLPAMLAEWRP...KLGNIGWDQ...GRR.................
C.clementina_TC31598#1            ..................................................
C.clementina_TC18948#1            IGSRLPAILAEWRP...KLGEYRGIK...GRRIEKSLLRDSV...SNALT
P.trifoliata_TA5851_37690#1       IGSRLPAMLAEWRP...KLGNIVGIK...AGGIEKVLVRDSV...SNALT
P.trichocarpa_769638#1            VGFRMPEVFAELRP...MLGKIVGVSGGGGGGAKKVYVRDDV...IGELT
P.trichocarpa_832731#1            VGFRVPEVFAELRP...TLGKIVGVV...VGGVEKVYVRDDV...IGELT
Pt putative MP dehydrogenase      VGFRVPEVFAELRP...TLGKIVGVV...VGGVEKVYVRDDV...IGELT
R.communis_TA1965_3988#1          VGCRIPEILAEWRP...RLGKFVGIS.SGGGGVGKVYVRDDV...IGRLT
G.hirsutum_TC134197#1             LDCRQPVILTEWSP....................................
M.domestica_TC34673#1             VGCRIPAILADWGP...QLGRMVGVA...SGVDDKVYVKDGV...IGKVT
G.max_Glyma10g41960.1#1           LRRRIPAMMAEWGP...SLGKTVGVV...ESSQVHKLYVKDDG...RYGFT
G.max_TC278929#1                  LRRRKPTVVAEWGP...TVGKTLHVE...SGGVQKVYVRDDG...RYSVT
G.max_TC339602#1                  LRRRKPTVVAEWGP...TVGKTLRVE...SGGVQKVYVRDDG...RYGVT
P.vulgaris_TC13663#1              LRRRKPSVVAEWGP...SMGKTLRVE...SGGVQKVYVRDDG...RHGVT
L.japonicus_TC42314#1             LRKRRPSVVAEWRP...AVGKTVRVE...SGGVSKVYVRDNG...RDGVT
M.truncatula_AC135604_14.4#1      LRRRKPSVVAEWGP...TVGNTLRVE...SGGVQKVYVRDNG...RQRLT
V.vinifera_GSVIVT00030351001#1    VGRQIPAIFAEWRP...QMGKRVSIS...TGGIEKVYVRDDV...IGELT
H.paradoxus_TA2948_73304#1        MGVTCPAVCAIWQP...QRKV.............................
H.petiolaris_DY945986#1           MGVTCPAVCAIWQP...RRKV.............................
L.saligna_DW067807#1              VDGQSPAIYAIWRP...RHRQI............................
L.serriola_TC6013#1               VDGKSPAIYAIWRP...RHRQI............................
L.virosa_DW158350#1               VDGKSPAIYAIWRS...RHRQL............................
L.sativa_TC23070#1                VDGKSPAIYAIWRP...RHRQI............................
T.officinale_TA2631_50225#1       VDEKSPAIYAIWRP...RHRQI............................
N.tabacum_TC41632#1               WRRRHHRWFCHRSE....................................
S.lycopersicum_TC193481#1         MRSNSPAIYADWGK...GSGKVVGVN...GSGVGKVYVRNES...AGKLT
O.basilicum_TA1347_39350#1        MRSSAPALYAEWRS...PAKKRGGVP...TTGVGKVYVRDDV...SGVVT
T.versicolor_TC2688#1             MKSRSPAFYADWGLIEAVEKVSAAVA...VGGVGKVYVKDGV...SGKLT
Aquilegia_sp_TC24194#1            VGRQIPQIFAEWQ...................RINCSDDIDSNANSLV
Aquilegia_sp_TC25879#1            VGRQIPQIFAEWQ...................RINCSDDIDSNANSLV
```

FIGURE 13 (continued)

```
                                         351                                                400
A.lyrata_475964#1                        VGDLRKFNGVLTDLTESEA.ETWWDADVVIS....................
A.thaliana_AT1G68440.1#1                 VGDLRKFNGVLTDLTECEA.ETWWDADVLIS....................
A.lyrata_921679#1                        VGDMRMVNGALTELTESEV.......EGMVRRRRRRRR.............
A.thaliana_AT1G25400.1#1                 VGDMRMVNGALTELTESEV.......ERMVRRRRRRR..............
C.clementina_DY272345#1                  VVDLRKGNSPF........................................
C.clementina_TC10465#1                   ...................................................
C.clementina_TC31598#1                   ...................................................
C.clementina_TC18948#1                   GGGHAQ.............................................
P.trifoliata_TA5851_37690#1              VGDMRKVNSPLDDPTEADV.DTWWDADAVIVTEDCLDNS............
P.trichocarpa_769638#1                   VGDIRKVSSPLVNVTESDV.DTWWDADAVIVEDECEKS.............
P.trichocarpa_832731#1                   VGDMRKPSSPLVNVTESDV.DTWWETDAVIVENECEKS.............
Pt_putative_MP_dehydrogenase             VGDMRKPSSPLVNVTESDV.DTWWDADAVIVENECEKS.............
R.communis_TA1965_3988#1                 VGDMRKVKSPLVNATETDV.DTWWDADGVSVGEEDNGVGSSPDSVLLR..
G.hirsutum_TC134197#1                    .......EKPWRNLSGQ..................................
M.domestica_TC34673#1                    IGDVRKVASPLGNVTGADLDDTWWDADAVVVTDERFDESAMRGCDSAV..
G.max_Glyma10g41960.1#1                  VGDMRNARSPLQYVTDSHL.DLW~~~~~~~~~~~~~~~~~~~~~~~~~~~
G.max_TC278929#1                         VGDMRKVSTPLGNVTESDA.DTWWDADAIVVSDESFGEQQSMLQQP....
G.max_TC339602#1                         VGDMRKVSTPLESVTESDA.DTWWDADAIVVSDESFGEQQSMLQQP....
P.vulgaris_TC13663#1                     VGDMRNVSTPLGNMTESDA.DTWWDADAIVVSDE....QQSMLQQP....
L.japonicus_TC42314#1                    VGDMRKVSKPLGNVTESDADNTWWDASEEQQSSMMHQ..............
M.truncatula_AC135604_14.4#1             VGDMRKVSFPLGNVTESDADNTWWDADAVIVTDESYGK.............
V.vinifera_GSVIVT00003035100I#1          VGDMRNASSPLQNVTECDG.GTWWDADAVMVYKDYVDQFMYSRYVPLLNK
H.paradoxus_TA2948_73304#1               ...................................................
H.petiolaris_DY945986#1                  ...................................................
L.saligna_DW067807#1                     ....................WADDESVTG......................
L.serriola_TC6013#1                      ....................WADDESVTGQK...E................
L.virosa_DW158350#1                      ....................WADDESVTGQK...E................
L.sativa_TC23070#1                       ....................WADDESVTGSEGRVS................
T.officinale_TA2631_50225#1              ....................WSEDESVTGEK...E................
N.tabacum_TC41632#1                      ...................................................
S.lycopersicum_TC193481#1                VGDLRNVKTPLEKIDG....DTWWDADAVIVEEKFDGSK............
O.basilicum_TA1347_39350#1               VGDVRNVRRPLESARESDG.DTWWDADAVIVENEFESS..............
T.versicolor_TC2688#1                    VGDVRNVRRPLESVRESNG.ETWWDADAVIVEDE.................
Aquilegia_sp_TC24194#1                   IRDIRKLGSPL.NLTESDV.NTWWDTDAVIVEGDREICYLGRKECGSV..
Aquilegia_sp_TC25879#1                   IRDIRKLGSPL.NLTESDV.NTWWDTDAVIVEGDRDICYLGRKECGSV..
```

FIGURE 13 (continued)

```
                                                    401                                               450
A.lyrata_475964#1                                   ..................................................G
A.thaliana_AT1G68440.1#1                            ..................................................G
A.lyrata_921679#1                                   ..................................................H
A.thaliana_AT1G25400.1#1                            ..................................................H
C.clementina_DY272345#1                             ..................................................K
C.clementina_TC10465#1                              ..................................................N
C.clementina_TC31598#1                              ..................................................R
C.clementina_TC18948#1                              ..................................................G
P.trifoliata_TA5851_37690#1                         ..................................................N
P.trichocarpa_769638#1                              ..................................................V
P.trichocarpa_832731#1                              ..................................................V
Pt_putative_MP_dehydrogenase                        ..................................................V
R.communis_TA1965_3988#1                            ..................................................G
G.hirsutum_TC134197#1                               ..................................................Y
M.domestica_TC34673#1                               ....................................TRCCS.......AVRSYLL
G.max_Glyma10g41960.1#1                             ~~~~~~~~~~~~~~~~~~~~~~~~~~~~~~~~~~~~~~~~~~~~~~~~~~
G.max_TC278929#1                                    ..................................................T
G.max_TC339602#1                                    ..................................................T
P.vulgaris_TC13663#1                                ..................................................T
L.japonicus_TC42314#1                               ..................................................T
M.truncatula_AC135604_14.4#1                        ..................................................H
V.vinifera_GSVIVT00030351001#1                      LLSYIHPLFSMLLSFTLFTPPWIYHSSLIISLSVCLSVSLSFPCQTTFFE
H.paradoxus_TA2948_73304#1                          ..................................................E
H.petiolaris_DY945986#1                             ..................................................E
L.saligna_DW067807#1                                ..................................................X
L.serriola_TC6013#1                                 ..................................................E
L.virosa_DW158350#1                                 ..................................................E
L.sativa_TC23070#1                                  ..................................................A
T.officinale_TA2631_50225#1                         ..................................................E
N.tabacum_TC41632#1                                 ..................................................K
S.lycopersicum_TC193481#1                           ..................................................N
O.basilicum_TA1347_39350#1                          ..................................................K
T.versicolor_TC2688#1                               ..................................................N
Aquilegia_sp_TC24194#1                              ................................VSRCRNAVFSNLNKVRNYI
Aquilegia_sp_TC25879#1                              ................................VSRCRNAVFSNLNKVRNYI
```

FIGURE 13 (continued)

|  | 1 | 2 | 3 | 4 | 5 | 6 | 7 | 8 | 9 | 10 | 11 | 12 |
|---|---|---|---|---|---|---|---|---|---|---|---|---|
| 1. P t putative MP dehydrogenase |  | 42.5 | 39.9 | 39.9 | 40.5 | 35.7 | 35.9 | 43.9 | 40.5 | 42.8 | 32.9 | 44.3 |
| 2. A. lyrata 475964#1 | 61.7 |  | 56.5 | 54.8 | 94.5 | 27.5 | 27.4 | 36.1 | 33.2 | 34.8 | 29.4 | 36.9 |
| 3. A. lyrata 921679#1 | 59 | 72.3 |  | 90.8 | 56.1 | 26.8 | 26.4 | 32.5 | 31.6 | 31.2 | 28.6 | 34.1 |
| 4. A. thaliana AT1G25400.1#1 | 57.8 | 72.3 | 94.8 |  | 56.1 | 26.8 | 27.6 | 32.4 | 31.5 | 31.7 | 28.7 | 35.1 |
| 5. A. thaliana AT1G68440.1#1 | 59.6 | 96.7 | 71.6 | 71.9 |  | 26.9 | 27.2 | 36.7 | 34.1 | 35.1 | 28.6 | 37.3 |
| 6. Aquilegia sp TC24194#1 | 58.8 | 47.8 | 45.7 | 46.9 | 47.5 |  | 97.4 | 30.7 | 30.7 | 30.1 | 24.1 | 32.2 |
| 7. Aquilegia sp TC25879#1 | 58.8 | 48.8 | 45.9 | 47.1 | 47.1 | 97.6 |  | 31.6 | 31.7 | 30.4 | 25.7 | 31.8 |
| 8. C. clementina DY272345#1 | 64.5 | 58.9 | 54.5 | 55.4 | 57 | 53.4 | 52.4 |  | 89.8 | 89.6 | 74.8 | 46.1 |
| 9. C. clementina TC10465#1 | 59 | 55.7 | 55.3 | 57.3 | 54.2 | 50.7 | 50.3 | 90.1 |  | 88.2 | 81.6 | 49.7 |
| 10. C. clementina TC18948#1 | 61.7 | 57.8 | 53.7 | 55 | 56.2 | 51.6 | 51.8 | 93.3 | 89.5 |  | 74.1 | 46.9 |
| 11. C. clementina TC31598#1 | 48.5 | 49.2 | 45.7 | 46.5 | 48.7 | 42.1 | 42.4 | 76.4 | 82.6 | 75.7 |  | 44.3 |
| 12. G. hirsutum TC134197#1 | 58.4 | 53.4 | 53.3 | 52.8 | 53.6 | 50.1 | 49.7 | 61.5 | 67 | 62.6 | 63.2 |  |
| 13. G max Glyma10g41960.1#1 | 45.8 | 41 | 42.3 | 42.7 | 39.2 | 38.5 | 38.5 | 46.8 | 46.5 | 44.1 | 46.3 | 48.9 |
| 14. G max TC278929#1 | 63.3 | 60.5 | 53.4 | 52.7 | 56.6 | 54.6 | 54.7 | 60.5 | 56.3 | 59.1 | 47.9 | 55.9 |
| 15. G max TC339602#1 | 63 | 59.6 | 52.1 | 52.7 | 56.5 | 51.9 | 52.4 | 58.4 | 53.6 | 57.4 | 46.4 | 52.7 |
| 16. H. paradoxus TA2948 73304#1 | 49.1 | 43.3 | 45.4 | 45.8 | 43.1 | 46.9 | 46.5 | 52.9 | 57.3 | 54 | 55.2 | 56.8 |
| 17. H. petiolaris DY945986#1 | 49.4 | 43.6 | 46 | 45.8 | 43.8 | 48.1 | 47.6 | 52.9 | 57.3 | 54 | 55.2 | 57.5 |
| 18. L. japonicus TC42314#1 | 59.3 | 58.2 | 54 | 52.7 | 55.9 | 51.3 | 51.8 | 59.2 | 55 | 58.1 | 47.6 | 54 |
| 19. L. saligna DW067807#1 | 50.6 | 43.6 | 48.5 | 48.6 | 45.1 | 46 | 45.3 | 51.6 | 56.3 | 53.4 | 53.4 | 57.9 |
| 20. L. sativa TC23070#1 | 51.2 | 46.6 | 50.5 | 50 | 46.1 | 47.2 | 46.8 | 52.5 | 56.9 | 53.7 | 53.2 | 58.4 |
| 21. L. serriola TC6013#1 | 51.8 | 45.3 | 49.8 | 50 | 47.4 | 47.2 | 46.5 | 53.2 | 56.9 | 54.6 | 53 | 60.2 |
| 22. L. virosa DW158350#1 | 51.5 | 45.3 | 49.8 | 49.3 | 47.4 | 47.5 | 46.8 | 51.9 | 55.6 | 52.4 | 52.6 | 59.8 |
| 23. M. domestica TC34673#1 | 59.9 | 58 | 52.8 | 50.5 | 57.3 | 53.1 | 53.5 | 53.5 | 49.5 | 50.5 | 45.6 | 51.1 |
| 24. M. truncatula AC135604 14.4#1 | 61.1 | 60.2 | 54.5 | 52.9 | 57.6 | 51.6 | 52.6 | 58.6 | 53.8 | 55.7 | 46.8 | 54.8 |
| 25. N. tabacum TC41632#1 | 43.7 | 41.7 | 43 | 41 | 40.5 | 42.4 | 42.6 | 45.5 | 49 | 45.7 | 55 | 53 |
| 26. O. basilicum TA1347 39350#1 | 60.5 | 55.3 | 49.5 | 48.9 | 54 | 52.2 | 51.2 | 57.3 | 54.7 | 57.2 | 45 | 51.8 |
| 27. P. trichocarpa 769638#1 | 85.8 | 64.3 | 58.8 | 59.2 | 63.3 | 53.4 | 53.2 | 62.7 | 57.9 | 60.7 | 51.8 | 60.5 |
| 28. P. trichocarpa 832731#1 | 83.7 | 62.5 | 61.2 | 60.8 | 63.1 | 51.9 | 52.1 | 57.3 | 58.3 | 54.6 | 57.3 | 62.4 |
| 29. P. trifoliata TA5851 37690#1 | 69.5 | 61 | 55.1 | 56.6 | 58.9 | 58.4 | 58.9 | 88.9 | 81.8 | 86.2 | 69.2 | 57.2 |
| 30. P. vulgaris TC13663#1 | 64.5 | 61.8 | 54 | 53.1 | 59.2 | 53.1 | 53.2 | 59.9 | 56.3 | 58.8 | 49.2 | 56 |
| 31. R. communis TA1965 3988#1 | 73 | 58.2 | 54.6 | 55.8 | 58.2 | 56.4 | 56.8 | 63.5 | 59.3 | 63.5 | 48.4 | 58.8 |
| 32. S. lycopersicum TC193481#1 | 62.3 | 54 | 53.4 | 52.7 | 53.4 | 57.6 | 57.6 | 54.8 | 51.8 | 55.3 | 44.4 | 53.7 |
| 33. T. officinale TA2631 50225#1 | 51.5 | 48.2 | 49.1 | 49 | 46.1 | 45.7 | 45 | 53.5 | 57.6 | 54.6 | 53 | 60.5 |
| 34. T. versicolor TC2688#1 | 58.7 | 48.9 | 51.5 | 50.5 | 52.3 | 49 | 49.7 | 55.7 | 52.8 | 54.6 | 45.9 | 51.8 |
| 35. V. vinifera GSVIVT00030351001#1 | 61.3 | 48.5 | 47.1 | 47.6 | 47.9 | 56 | 57.4 | 52.4 | 47.9 | 50.7 | 38.1 | 48.7 |

FIGURE 15

| | 13 | 14 | 15 | 16 | 17 | 18 | 19 | 20 | 21 | 22 | 23 | 24 |
|---|---|---|---|---|---|---|---|---|---|---|---|---|
| 1.P.t putative MP dehydrogenase | 32.4 | 42.9 | 41.5 | 31.3 | 30.6 | 39.2 | 30.5 | 30.2 | 31.1 | 30.5 | 40.5 | 42.4 |
| 2.A.lyrata_475964#1 | 24.8 | 36.4 | 34.7 | 31.1 | 31.4 | 34.3 | 24.3 | 27.7 | 26.5 | 26.5 | 36.3 | 34.4 |
| 3.A.lyrata_921679#1 | 28.1 | 31.6 | 31.4 | 27.4 | 28.4 | 34.1 | 26.3 | 27.4 | 26.8 | 27.7 | 32.5 | 32.3 |
| 4.A.thaliana_AT1G25400.1#1 | 26.8 | 31.7 | 30.1 | 28.3 | 28.6 | 33.2 | 28 | 28.8 | 28.5 | 28.8 | 31.8 | 33.2 |
| 5.A.thaliana_AT1G68440.1#1 | 23.9 | 33.8 | 33.4 | 30.5 | 31.1 | 34.9 | 27.4 | 27.8 | 27.3 | 27.3 | 36.1 | 33.7 |
| 6.Aquilegia_sp_TC24194#1 | 26.1 | 29.8 | 28.6 | 29.9 | 30.7 | 29.2 | 28.5 | 28.8 | 29.1 | 29.1 | 33.1 | 29.8 |
| 7.Aquilegia_sp_TC25879#1 | 26 | 29.9 | 28 | 30.3 | 31.1 | 29 | 28.6 | 28.9 | 29.1 | 29.1 | 33 | 30.1 |
| 8.C.clementina_DY272345#1 | 30.8 | 34 | 32 | 32.3 | 32.3 | 32.4 | 30.7 | 31.4 | 31.4 | 31.1 | 32.7 | 31.3 |
| 9.C.clementina_TC10465#1 | 29.2 | 32.6 | 30.3 | 35.1 | 34.8 | 30.3 | 33.8 | 32.9 | 33.9 | 33.2 | 30.6 | 29.3 |
| 10.C.clementina_TC18948#1 | 27.7 | 33.3 | 31.9 | 33.3 | 33.3 | 32.7 | 33 | 32.6 | 33.6 | 33 | 31.4 | 30.7 |
| 11.C.clementina_TC31598#1 | 24.8 | 29.3 | 27.7 | 31.2 | 31.5 | 27.2 | 29.4 | 30.2 | 29.5 | 29.8 | 30.5 | 26.3 |
| 12.G.hirsutum_TC134197#1 | 26.9 | 32.3 | 30.6 | 32.3 | 33 | 34.2 | 31.2 | 30.4 | 31.1 | 31.7 | 37 | 31.1 |
| 13.G.max_Glyma10g41960.1#1 | | 39 | 39.3 | 25.1 | 25.4 | 37.9 | 25.2 | 24.8 | 25.6 | 27.5 | 29.3 | 36.4 |
| 14.G.max_TC278929#1 | 51.8 | | 88.8 | 27.1 | 27.7 | 66.9 | 26.3 | 26.8 | 26 | 27.3 | 36.5 | 66.4 |
| 15.G.max_TC339602#1 | 50.8 | 92.4 | | 28.5 | 28.5 | 66.2 | 27.4 | 27.4 | 28.1 | 28.1 | 37.3 | 64.1 |
| 16.H.paradoxus_TA2948_73304#1 | 44.8 | 46 | 46.1 | | 98.8 | 27.8 | 66.3 | 64.5 | 66.7 | 65.9 | 33.1 | 28 |
| 17.H.petiolaris_DY945986#1 | 44.8 | 46.6 | 45.7 | 99.2 | | 27.8 | 67 | 65.2 | 67.4 | 66.7 | 33.1 | 28 |
| 18.L.japonicus_TC42314#1 | 51.1 | 80.4 | 78.9 | 43.4 | 44.1 | | 29.8 | 29.8 | 29.6 | 29.3 | 34.5 | 63.5 |
| 19.L.saligna_DW067807#1 | 42.7 | 45 | 44.2 | 80.5 | 80.9 | 45.7 | | 94.1 | 96.2 | 95.1 | 30.1 | 30.1 |
| 20.L.sativa_TC23070#1 | 43.1 | 44.1 | 42.9 | 78.4 | 78.8 | 45 | 95.5 | | 96.3 | 95.5 | 29.3 | 28 |
| 21.L.serriola_TC6013#1 | 43.6 | 46 | 43.5 | 79.7 | 80.1 | 46 | 97 | 97.4 | | 98.9 | 29.3 | 28.6 |
| 22.L.virosa_DW158350#1 | 45.9 | 44.7 | 43.2 | 78.9 | 79.3 | 45.7 | 96.2 | 96.7 | 99.2 | | 29.6 | 28.6 |
| 23.M.domestica_TC34673#1 | 42.7 | 56.9 | 56.5 | 46.6 | 46.9 | 57.6 | 46.6 | 46.6 | 45.6 | 46.3 | | 35.9 |
| 24.M.truncatula_AC135604_14.4#1 | 50.3 | 82.2 | 80.8 | 46.8 | 46.8 | 77.7 | 47.8 | 47.1 | 47.5 | 47.1 | 58.6 | |
| 25.N.tabacum_TC41632#1 | 43.6 | 41.2 | 41 | 59.2 | 59.2 | 41.5 | 57.3 | 56.1 | 57.5 | 57.1 | 42.7 | 41.4 |
| 26.O.basilicum_TA1347_39350#1 | 44.4 | 60.1 | 60.9 | 47.6 | 48.2 | 57.6 | 48.2 | 48.2 | 48.9 | 49.2 | 54.3 | 59.6 |
| 27.P.trichocarpa_769638#1 | 43.4 | 63.7 | 61.8 | 49.5 | 49.5 | 59.8 | 49.8 | 50.5 | 51.4 | 51.4 | 63.3 | 61.5 |
| 28.P.trichocarpa_832731#1 | 47 | 59.5 | 58.7 | 53 | 53.4 | 56.6 | 52.7 | 53.8 | 53.8 | 54.1 | 62.9 | 58.3 |
| 29.P.trifoliata_TA5851_37690#1 | 44.9 | 63.3 | 62.5 | 49 | 49 | 60.4 | 49 | 50.1 | 49.9 | 48.7 | 55.7 | 61.3 |
| 30.P.vulgaris_TC13663#1 | 54.7 | 90 | 89.9 | 45.6 | 45.3 | 82.6 | 43.4 | 45 | 44.7 | 44.3 | 60.5 | 80.9 |
| 31.R.communis_TA1965_3988#1 | 46.6 | 59.9 | 61.1 | 46.9 | 45.1 | 59.6 | 47.8 | 49 | 49 | 49 | 60.8 | 60.8 |
| 32.S.lycopersicum_TC193481#1 | 45.7 | 58.5 | 56.5 | 53.4 | 53 | 54.6 | 55.6 | 57.2 | 57.5 | 57.8 | 58.5 | 60.8 |
| 33.T.officinale_TA2631_50225#1 | 43.6 | 47.6 | 46.1 | 78.9 | 79.3 | 45.3 | 94 | 93.7 | 96.2 | 95.5 | 45.3 | 49 |
| 34.T.versicolor_TC2688#1 | 45.2 | 56.6 | 57.4 | 50.5 | 51.5 | 55 | 53.1 | 53.1 | 54.1 | 54.1 | 55 | 57 |
| 35.V.vinifera_GSVIVT00030351001#1 | 39.5 | 53.8 | 54.1 | 41.7 | 41.7 | 50.7 | 40.6 | 42.9 | 41.7 | 41.7 | 53.8 | 52.9 |

FIGURE 15 (continued)

|  | 25 | 26 | 27 | 28 | 29 | 30 | 31 | 32 | 33 | 34 | 35 |
|---|---|---|---|---|---|---|---|---|---|---|---|
| 1.P.t putative MP dehydrogenase | 31.5 | 41.8 | 79.7 | 83.1 | 51.7 | 41.8 | 58 | 42.4 | 32.3 | 40.7 | 40.9 |
| 2.A.lyrata_475964#1 | 26 | 36.8 | 43.6 | 43.3 | 40.3 | 37 | 38.4 | 34.3 | 28.4 | 30.8 | 29.6 |
| 3.A.lyrata_921679#1 | 28.6 | 31.2 | 39.4 | 39.2 | 34.7 | 33 | 36.3 | 31.5 | 27.8 | 32.6 | 30.4 |
| 4.A.thaliana_AT1G25400.1#1 | 26.2 | 30.8 | 39.1 | 40.6 | 34.4 | 31.9 | 37.4 | 31.5 | 28.4 | 32.4 | 31 |
| 5.A.thaliana_AT1G68440.1#1 | 25.5 | 36.8 | 42.6 | 42.2 | 40.6 | 35.5 | 38.6 | 35 | 28.2 | 32.7 | 29.4 |
| 6.Aquilegia_sp_TC24194#1 | 25.9 | 31.4 | 34.1 | 33.5 | 34.5 | 28 | 36.3 | 35.9 | 27.8 | 28.9 | 34.6 |
| 7.Aquilegia_sp_TC25879#1 | 27.7 | 31.3 | 33.8 | 33.2 | 34.5 | 28.8 | 36.8 | 36.4 | 28.6 | 29.5 | 36 |
| 8.C.clementina_DY272345#1 | 28.8 | 32.5 | 41.2 | 37.1 | 86.2 | 31.7 | 42 | 32.5 | 32.3 | 31.4 | 31.7 |
| 9.C.clementina_TC10465#1 | 31 | 30.8 | 40 | 37 | 80.9 | 30.9 | 39.3 | 31 | 33.4 | 30.2 | 28.5 |
| 10.C.clementina_TC18948#1 | 29.6 | 31.8 | 39.7 | 36.1 | 84.1 | 30.5 | 41.8 | 30.8 | 33 | 30.8 | 30.6 |
| 11.C.clementina_TC31598#1 | 32.7 | 25.7 | 36.5 | 36.7 | 67.4 | 27.8 | 31.3 | 24.9 | 30.1 | 26.8 | 23.1 |
| 12.G.hirsutum_TC134197#1 | 34.8 | 31.8 | 48.2 | 45.2 | 43.4 | 33.3 | 45.2 | 33.4 | 33.7 | 28.4 | 29.8 |
| 13.G.max_Glyma10g41960.1#1 | 21.1 | 28.2 | 30.4 | 30.1 | 30.7 | 41 | 31.6 | 25.9 | 26.1 | 30.3 | 27.8 |
| 14.G.max_TC278929#1 | 25.9 | 38.6 | 40.2 | 40.5 | 39.3 | 80.9 | 40.4 | 33.2 | 28.2 | 35.6 | 37 |
| 15.G.max_TC339602#1 | 25.2 | 37.3 | 39.7 | 39.5 | 38.1 | 80.8 | 41.1 | 33.7 | 29.2 | 35.6 | 36.4 |
| 16.H.paradoxus_TA2948_73304#1 | 40.8 | 32 | 32.2 | 32.9 | 30.4 | 26.8 | 28.2 | 34 | 65.9 | 34.7 | 24 |
| 17.H.petiolaris_DY945986#1 | 40.4 | 32.6 | 31.8 | 32.1 | 30.4 | 26.8 | 28.3 | 34.4 | 66.7 | 35.8 | 24 |
| 18.L.japonicus_TC42314#1 | 25.3 | 35.8 | 37.9 | 37.6 | 38.2 | 66.8 | 39 | 33 | 31.2 | 33.8 | 33.1 |
| 19.L.saligna_DW067807#1 | 40 | 32.7 | 30.3 | 31.4 | 28.7 | 25.4 | 28.5 | 36.7 | 89.5 | 35.3 | 24.2 |
| 20.L.sativa_TC23070#1 | 39.1 | 32.4 | 30.3 | 32.4 | 28.7 | 27.8 | 28 | 38.4 | 88.5 | 35.6 | 25 |
| 21.L.serriola_TC6013#1 | 40.3 | 33 | 30.8 | 32.8 | 28.9 | 28 | 29 | 38.8 | 91.7 | 36.2 | 24.5 |
| 22.L.virosa_DW158350#1 | 39.6 | 33 | 30.8 | 33.1 | 28.7 | 27.7 | 29 | 38.6 | 90.6 | 36.5 | 24.7 |
| 23.M.domestica_TC34673#1 | 29.1 | 32.6 | 41.2 | 44.4 | 38.3 | 37 | 40.9 | 38.2 | 29.3 | 35.8 | 33.5 |
| 24.M.truncatula_AC135604_14.4#1 | 26.2 | 37.8 | 41.4 | 40.3 | 38.2 | 66.1 | 37.9 | 35.5 | 29.5 | 37.2 | 33.8 |
| 25.N.tabacum_TC41632#1 |  | 34.9 | 31.3 | 33.4 | 26.9 | 25.2 | 28.9 | 52.8 | 39.7 | 33.3 | 23.7 |
| 26.O.basilicum_TA1347_39350#1 | 48.6 |  | 41.4 | 38.1 | 38.9 | 38.5 | 39.4 | 48.7 | 33.3 | 61.2 | 32.1 |
| 27.P.trichocarpa_769638#1 | 46 | 61.7 |  | 76.2 | 48.5 | 41.3 | 55.3 | 40.2 | 32.5 | 38.8 | 36.7 |
| 28.P.trichocarpa_832731#1 | 48.7 | 55.6 | 82.3 |  | 44.7 | 39.6 | 51.4 | 37 | 33.7 | 35.7 | 35.5 |
| 29.P.trifoliata_TA5851_37690#1 | 42.5 | 60.7 | 66.3 | 59.8 |  | 37 | 49.2 | 37 | 29.4 | 36.6 | 36.4 |
| 30.P.vulgaris_TC13663#1 | 40.1 | 62.7 | 65.6 | 62.1 | 63 |  | 40.8 | 33.8 | 28 | 36.7 | 34.6 |
| 31.R.communis_TA1965_3988#1 | 40.7 | 57 | 69.1 | 60.8 | 69.5 | 58.8 |  | 40.4 | 28.4 | 36.4 | 40.1 |
| 32.S.lycopersicum_TC193481#1 | 62.6 | 70.3 | 61.7 | 55.3 | 56.9 | 56.2 | 60.8 |  | 37.2 | 48.3 | 33.2 |
| 33.T.officinale_TA2631_50225#1 | 55.6 | 49.5 | 50.2 | 53 | 50.4 | 45.3 | 47.2 | 55.9 |  | 36.6 | 23.5 |
| 34.T.versicolor_TC2688#1 | 50.2 | 76.8 | 57.9 | 55.4 | 57.5 | 58.9 | 55.2 | 68.1 | 54.8 |  | 32.6 |
| 35.V.vinifera_GSVIVT00030351001#1 | 39.2 | 50.7 | 57.1 | 53.8 | 58.5 | 55.2 | 59.4 | 54.9 | 41.5 | 50.4 |  |

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/IB2011/053135, filed Jul. 13, 2011, which claims benefit of U.S. Provisional Application No. 61/364,847, filed Jul. 16, 2010, U.S. Provisional Application No. 61/366,962, filed Jul. 23, 2010, and U.S. Provisional Application No. 61/376,323, filed Aug. 24, 2010.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_32279_00055. The size of the text file is 1,033 KB, and the text file was created on Jan. 14, 2013.

The present invention relates generally to the field of molecular biology and concerns a method for enhancing yield-related traits in plants by modulating expression in a plant of a nucleic acid encoding a DEAD-box RNA helicase polypeptide, or a CER2-like (CER2-like acyl transferase) polypeptide, or an At1g68440-like (putative IMP dehydrogenase/GMP reductase from *Populus trichocarpa*) polypeptide. The present invention also concerns plants having modulated expression of a nucleic acid encoding a DEAD-box RNA helicase polypeptide, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the abovementioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta 218, 1-14, 2003). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

It has now been found that various yield-related traits may be improved in plants by modulating expression in a plant of a nucleic acid encoding a DEAD-box RNA helicase polypeptide, or a CER2-like (CER2-like acyl transferase) polypeptide, or an At1g68440-like polypeptide in a plant.

BACKGROUND

1. DEAD-Box RNA Helicase Polypeptide

DEAD-box proteins play important roles in RNA metabolism and their role seem to be very specific. In yeast, studies have shown that DEAD-box proteins are involved in controlling temporal remodelling of the ribonucleoprotein (RNP) complex. In literature, some DEAD-box proteins have been shown to have RNA-dependent ATP-ase and ATP-dependent RNA helicase activities in vitro. Such helicase activities require energy and allow unwinding of double stranded nucleic acids (dsDNA or dsRNA). DEAD-box and related DEAH, DExH, and DExD families, which are commonly referred to as the DExD/H helicase family, are members of the SF2 family, and share nine highly conserved motifs (Gorbalenya and Koonin, 1993; Tanner and Linder, 2001; Caruthers and McKay, 2002). These closely related families can be distinguished by variations within their conserved motifs. The DEAD-box family is by far the largest one, and is characterized by the presence of nine conserved motifs that are involved in ATPase and helicase activities and in their regulation (Tanner et al., 2003). The conserved motifs of the DExD/H helicases are clustered in a central core region that spans 350-400 amino acids (Tanner and Linder, 2001; Caruthers and McKay, 2002). By contrast, the N- and C-terminal extensions are highly variable in size and composition (Caruthers and McKay, 2002).

The DEAD-box RNA helicases form a large family of proteins found in all eukaryotes, and most prokaryotes (Aubourg et al., 1999; de la Cruz et al., 1999; Rocak and Linder, 2004). For example, nearly 30 genes that encode DEAD-box RNA helicases were identified in genomes of *Caenorhabditis elegans* and *Drosophila melanogaster* (Boudet et al., 2001). In *Arabidopsis*, >50 members of DEAD-box RNA helicases have been identified (Aubourg et al., 1999; Boudet et al., 2001). Aubourg et al. (1999) characterized six subfamilies of DEAD-box RNA helicases in *Arabidopsis*. Similarities between the members of these subfamilies and known DEAD-box RNA helicases from other organisms were found to be suggesting possible functions (Auburg et al., 1999).

Despite the involvement of DEAD-box RNA helicases in many diverse biological processes, their precise functions and regulation largely remain to be elucidated.

2. CER2-Like Polypeptides

The vital importance of plant surface wax in protecting tissue from environmental stresses is reflected in the huge commitment of epidermal cells to cuticle formation (Samuels et al. (2008). Ann. Rev. Plant Biol. 59:683-707). Plants are subject to a wide range of abiotic stresses, and their cuticular wax layer provides a protective barrier, which consists predominantly of long-chain hydrocarbon compounds, including alkanes, primary alcohols, aldehydes, secondary alcohols, ketones, esters and other derived compounds (Sheperd et al. (2006). New Phytol. 171(3):469-99). Modification of leaf cuticular wax accumulation could be achieved by modulating expression of genes encoding different enzymes in the pathway. In *Arabidopsis*, a series of so called CER mutants affected in cuticular wax biosynthesis were identified and some of the corresponding genes cloned. Xia and co-workers have found out that the *Arabidopsis* CER2 gene is expressed in an organ- and tissue-specific manner. Furthermore, CER2 is expressed at high levels only in the epidermis of young siliques and stems (Xia et al. (1996). Plant Cell. 8(8):1291-304). In agreement with the activity of the CER2 promoter in hypocotyls, cuticular wax accumulates on this organ in a CER2-dependent fashion. In leaves CER2 expression is confined to the guard cells, trichomes, and petioles (Xia et al. (1997). Plant Physiol. 115(3):925-37). Expression profile characterization showed developmental regulation of wax biosynthesis. Whereas some genes like CER6 were induced by light and osmotic stress, surprisingly, CER2 expression in *Arabidopsis* was unaffected by abiotic stress (Cha et al. (2007). Anal Chem. 81(8):2991-3000; Cha et al. (2008). Plant J. 55(2):348-360). Broun et al. (2004, PNAS. 101(13):4706-11) demonstrated in gene expression analyses that a number of genes, such as CER1, KCS1, and CER2, which are known to be involved in wax biosynthesis, were induced in WIN1, an ERF-type transcription factor. Furthermore, Islam et al. showed that a modification of leaf wax accumulation alters drought response in rice. The *Oryza* gene GLOSSYI (GLI) is closely related to *Arabidopsis* CER1 encoding an aldehyde decarbonylase involved in stem wax accumulation and pollen fertility (Islam et al. (2009). Plant Mol. Boil. 70(4):443-456).

3. At1g68440-Like Polypeptides

The *Arabidopsis thaliana* orthologue At1g68440 was identified—among others—as translationally regulated gene by DNA microarray analysis upon sucrose starvation of *Arabidopsis* cell culture (Nicolai, M., et al. Plant Physiol. 2006 June; 141(2):663-73). Comparison of transcriptional and translational gene lists highlighted the importance of translational regulation (mostly repression) affecting genes involved in cell cycle and cell growth, these being overrepresented in translationally regulated genes, providing a molecular framework for the arrest of cell proliferation following starvation. Furthermore, Baxter et al. (Plant Physiol. 2007 January; 143(1):312-25) have shown that there is a dramatic change in the abundance of transcripts involved in metabolism, such as At1g68440, that serves both to mobilize alternative carbon reserves and to reconfigure metabolic fluxes to bypass some of the inhibited pathways, to cope with the resultant metabolic restrictions upon exposure to oxidative stress. In addition, Atg68440 was demonstrated to be down-regulated in *Arabidopsis* knock-outs of Apolipoprotein D ortholog AtTIL, a member of the plant lipocalin family (Charron Jean-Benoit F, et al., BMC Plant Biol. 2008 Jul. 31; 8:86). AtTIL lipocalin is involved in modulating tolerance to oxidative stress. AtTIL knock-out plants are very sensitive to sudden drops in temperature and paraquat treatment, and dark-grown plants die shortly after transfer to light.

SUMMARY

1. DEAD-Box RNA Helicase Polypeptide

Surprisingly, it has now been found that reducing or substantially eliminating expression in a plant of a nucleic acid encoding an endogenous DEAD-box RNA helicase polypeptide gives plants having enhanced yield-related traits, in particular increased seed yield relative to control plants.

According one embodiment, there is provided a method for improving yield-related traits in plants relative to control plants, comprising reducing or substantially eliminating expression in a plant of a nucleic acid encoding an endogenous DEAD-box RNA helicase polypeptide.

The section captions and headings in this specification are for convenience and reference purpose only and should not affect in any way the meaning or interpretation of this specification.

2. CER2-Like Polypeptides

Surprisingly, it has now been found that modulating expression of a nucleic acid encoding a CER2-like polypeptide as defined herein gives plants having enhanced yield-related traits, in particular increased seed yield relative to control plants.

According another embodiment, there is provided a method for improving yield-related traits as provided herein in plants relative to control plants, comprising modulating expression in a plant of a nucleic acid encoding a CER2-like polypeptide as defined herein.

3. At1g68440-Like Polypeptides

Surprisingly, it has now been found that modulating expression of a nucleic acid encoding the newly identified poplar orthologue of At1g68440, which therefore was named At1g68440-like polypeptide, as defined herein gives plants having enhanced yield-related traits, in particular increased seed yield relative to control plants.

According still another embodiment, there is provided a method for improving yield-related traits as provided herein in plants relative to control plants, comprising modulating expression in a plant of a nucleic acid encoding an At1g68440-like polypeptide as defined herein.

The section captions and headings in this specification are for convenience and reference purpose only and should not affect in any way the meaning or interpretation of this specification.

DEFINITIONS

The following definitions will be used throughout the present specification.

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols (see Current Protocols in Molecular Biology, John Wiley & Sons, N.Y. (1989 and yearly updates)).

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The $T_m$ is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The $T_m$ may be calculated using the following equations, depending on the types of hybrids:

1) DNA-DNA hybrids (Meinkoth and Wahl, Anal. Biochem., 138: 267-284, 1984):

$$T_m=81.5° C.+16.6\times\log_{10} [Na^+]^a+0.41\times\%[G/C^b]-500\times[L^c]^{-1}-0.61\times\% \text{ formamide}$$

2) DNA-RNA or RNA-RNA hybrids:

$$T_m=79.8° C.+18.5(\log_{10} [Na^+]^a)+0.58(\%G/C^b)+11.8(\%G/C_b)^2-820/L^c$$

3) oligo-DNA or oligo-RNAs$^d$ hybrids:

For <20 nucleotides: $T_m=2(l_n)$

For 20-35 nucleotides: $T_m=22+1.46(l_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $l_n$, =effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Artificial DNA (such as but, not limited to plasmids or viral DNA) capable of replication in a host cell and used for introduction of a DNA sequence of interest into a host cell or host organism. Host cells of the invention may be any cell selected from bacterial cells, such as Escherichia coli or Agrobacterium species cells, yeast cells, fungal, algal or cyanobacterial cells or plant cells. The skilled artisan is well aware of the genetic elements that must be present on the genetic construct in order to successfully transform, select and propagate host cells containing the sequence of interest. The sequence of interest is operably linked to one or more control sequences (at least to a promoter) as described herein. Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or microorganisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| Arabidopsis PHT1 | Koyama et al. J Biosci Bioeng. 2005 January; 99(1): 38-42.; Mudge et al. (2002, Plant J. 31: 341) |
| Medicago phosphate transporter | Xiao et al., 2006, Plant Biol (Stuttg). 2006 July; 8(4): 439-49 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 17 (6): 1139-1154 |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat $\alpha$, $\beta$, $\gamma$-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice $\alpha$-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| *sorghum* $\alpha$-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| $\alpha$-amylase (Amy32b) | Lanahan et al, Plant Cell 4: 203-211, 1992; Skriver et al, Proc Natl Acad Sci USA 88: 7266-7270, 1991 |
| cathepsin $\beta$-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |

TABLE 2e-continued

Examples of embryo specific promoters:

| Gene source | Reference |
|---|---|
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
|---|---|---|
| Maize Orthophosphate dikinase | Leaf specific | Fukayama et al., Plant Physiol. 2001 November; 127(3): 1136-46 |
| Maize Phosphoenol-pyruvate carboxylase | Leaf specific | Kausch et al., Plant Mol Biol. 2001 January; 45(1): 1-15 |
| Rice Phosphoenol-pyruvate carboxylase | Leaf specific | Lin et al., 2004 DNA Seq. 2004 August; 15(4): 269-76 |
| Rice small subunit Rubisco | Leaf specific | Nomura et al., Plant Mol Biol. 2000 September; 44(1): 99-106 |
| rice beta expansin EXBP9 | Shoot specific | WO 2004/070039 |
| Pigeonpea small subunit Rubisco | Leaf specific | Panguluri et al., Indian J Exp Biol. 2005 April; 43(4): 369-72 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not present in, or originating from, the genome of said plant, or are present in the genome of said plant but not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

It shall further be noted that in the context of the present invention, the term "isolated nucleic acid" or "isolated polypeptide" may in some instances be considered as a synonym for a "recombinant nucleic acid" or a "recombinant polypeptide", respectively and refers to a nucleic acid or polypeptide that is not located in its natural genetic environment and/or that has been modified by recombinant methods.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. For the purposes of this invention, the original unmodulated expression may also be absence of any expression. The term "modulating the activity" shall mean any change of the expression of the inventive nucleic acid sequences or encoded proteins, which leads to increased yield and/or increased growth of the plants. The expression can increase from zero (absence of, or immeasurable expression) to a certain amount, or can decrease from a certain amount to immeasurable small amounts or zero.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level. For the purposes of this invention, the original wild-type expression level might also be zero, i.e. absence of expression or immeasurable expression.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404;

Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/ nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/ Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet. 208:1-9; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through Agrobacterium infection and leads to modified expression of genes near the inserted T-DNA. The resulting transgenic plants show dominant phenotypes due to modified expression of genes close to the introduced promoter.

Tilling

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in Arabidopsis Research, Koncz C, Chua N H, Schell J, eds. Singapore, World Scientific Publishing Co, pp. 16-82; Feldmann et al., (1994) In Meyerowitz E M, Somerville C R, eds, Arabidopsis. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss Physcomitrella. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits are traits or features which are related to plant yield. Yield-related traits may comprise one or more of the following non-limitative list of features: early flowering time, yield, biomass, seed yield, early vigour, greenness index, increased growth rate, improved agronomic traits, such as e.g. increased tolerance to submergence (which leads to increased yield in rice), improved Water Use Efficiency (WUE), improved Nitrogen Use Efficiency (NUE), etc.

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters.

The terms "yield" of a plant and "plant yield" are used interchangeably herein and are meant to refer to vegetative biomass such as root and/or shoot biomass, to reproductive organs, and/or to propagules such as seeds of that plant.

Flowers in maize are unisexual; male inflorescences (tassels) originate from the apical stem and female inflorescences (ears) arise from axillary bud apices. The female inflorescence produces pairs of spikelets on the surface of a central axis (cob). Each of the female spikelets encloses two fertile florets, one of them will usually mature into a maize kernel once fertilized. Hence a yield increase in maize may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate, which is the number of filled florets (i.e. florets containing seed) divided by the total number of florets and multiplied by 100), among others.

Inflorescences in rice plants are named panicles. The panicle bears spikelets, which are the basic units of the panicles, and which consist of a pedicel and a floret. The floret is borne on the pedicel and includes a flower that is covered by two protective glumes: a larger glume (the lemma) and a shorter glume (the palea). Hence, taking rice as an example, a yield increase may manifest itself as an increase in one or more of the following: number of plants per square meter, number of panicles per plant, panicle length, number of spikelets per panicle, number of flowers (or florets) per panicle; an increase in the seed filling rate which is the number of filled florets (i.e. florets containing seeds) divided by the total number of florets and multiplied by 100; an increase in thousand kernel weight, among others.

Early Flowering Time

Plants having an "early flowering time" as used herein are plants which start to flower earlier than control plants. Hence this term refers to plants that show an earlier start of flowering. Flowering time of plants can be assessed by counting the number of days ("time to flower") between sowing and the emergence of a first inflorescence. The "flowering time" of a plant can for instance be determined using the method as described in WO 2007/093444.

Early Vigour

"Early vigour" refers to active healthy well-balanced growth especially during early stages of plant growth, and may result from increased plant fitness due to, for example, the plants being better adapted to their environment (i.e.

optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. "Mild stresses" are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures.

"Biotic stresses" are typically those stresses caused by pathogens, such as bacteria, viruses, fungi, nematodes and insects.

The "abiotic stress" may be an osmotic stress caused by a water stress, e.g. due to drought, salt stress, or freezing stress. Abiotic stress may also be an oxidative stress or a cold stress. "Freezing stress" is intended to refer to stress due to freezing temperatures, i.e. temperatures at which available water molecules freeze and turn into ice. "Cold stress", also called "chilling stress", is intended to refer to cold temperatures, e.g. temperatures below 10°, or preferably below 5° C., but at which water molecules do not freeze. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

In particular, the methods of the present invention may be performed under non-stress conditions. In an example, the methods of the present invention may be performed under non-stress conditions such as mild drought to give plants having increased yield relative to control plants.

In another embodiment, the methods of the present invention may be performed under stress conditions.

In an example, the methods of the present invention may be performed under stress conditions such as drought to give plants having increased yield relative to control plants.

In another example, the methods of the present invention may be performed under stress conditions such as nutrient deficiency to give plants having increased yield relative to control plants.

Nutrient deficiency may result from a lack of nutrients such as nitrogen, phosphates and other phosphorous-containing compounds, potassium, calcium, magnesium, manganese, iron and boron, amongst others.

In yet another example, the methods of the present invention may be performed under stress conditions such as salt stress to give plants having increased yield relative to control plants. The term salt stress is not restricted to common salt (NaCl), but may be any one or more of: NaCl, KCl, LiCl, $MgCl_2$, $CaCl_2$, amongst others.

In yet another example, the methods of the present invention may be performed under stress conditions such as cold stress or freezing stress to give plants having increased yield relative to control plants.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following:

(a) an increase in seed biomass (total seed weight) which may be on an individual seed basis and/or per plant and/or per square meter;

(b) increased number of flowers per plant;

(c) increased number of seeds;

(d) increased seed filling rate (which is expressed as the ratio between the number of filled florets divided by the total number of florets);

(e) increased harvest index, which is expressed as a ratio of the yield of harvestable parts, such as seeds, divided by the biomass of aboveground plant parts; and (f) increased thousand kernel weight (TKW), which is extrapolated from the number of seeds counted and their total weight. An increased TKW may result from an increased seed size and/or seed weight, and may also result from an increase in embryo and/or endosperm size.

The terms "filled florets" and "filled seeds" may be considered synonyms.

An increase in seed yield may also be manifested as an increase in seed size and/or seed volume. Furthermore, an increase in seed yield may also manifest itself as an increase in seed area and/or seed length and/or seed width and/or seed perimeter.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Biomass

The term "biomass" as used herein is intended to refer to the total weight of a plant. Within the definition of biomass, a distinction may be made between the biomass of one or more parts of a plant, which may include any one or more of the following:

aboveground parts such as but not limited to shoot biomass, seed biomass, leaf biomass, etc.;

aboveground harvestable parts such as but not limited to shoot biomass, seed biomass, leaf biomass, etc.;

parts below ground, such as but not limited to root biomass, tubers, bulbs, etc.;

harvestable parts below ground, such as but not limited to root biomass, tubers, bulbs, etc.;

harvestable parts partially below ground such as but not limited to beets and other hypocotyl areas of a plant, rhizomes, stolons or creeping rootstalks;

vegetative biomass such as root biomass, shoot biomass, etc.;

reproductive organs; and propagules such as seed.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/ nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes (or null control plants) are individuals missing the transgene by segregation. Further, control plants are grown under equal growing conditions to the growing conditions of the plants of the invention, i.e. in the vicinity of, and simultaneously with, the plants of the invention. A "control plant" as used herein refers not only to whole plants, but also to plant parts, including seeds and seed parts.

DETAILED DESCRIPTION OF THE INVENTION

Concerning DEAD-box RNA helicase polypeptides, it has now been surprisingly found that reducing or substantially eliminating expression in a plant of a nucleic acid encoding a DEAD-box RNA helicase polypeptide gives plants having enhanced yield-related traits relative to control plants.

Concerning CER2-like polypeptides, it has now been surprisingly found that modulating expression in a plant of a nucleic acid encoding a CER2-like polypeptide gives plants having enhanced yield-related traits relative to control plants.

Concerning At1g68440-like polypeptides, it has now been found that modulating expression in a plant of a nucleic acid encoding an At1g68440-like polypeptide gives plants having enhanced yield-related traits relative to control plants.

Concerning DEAD-box RNA helicase polypeptides, according to a first embodiment, the present invention provides a method for enhancing yield-related traits in plants relative to control plants, comprising reducing or substantially eliminating expression in a plant of a nucleic acid encoding an endogenous DEAD-box RNA helicase polypeptide and optionally selecting for plants having enhanced yield-related traits.

According to another embodiment, the present invention provides a method for producing plants having enhanced yield-related traits relative to control plants, wherein said method comprises the steps of reducing or substantially eliminating expression in said plant of a nucleic acid encoding an endogenous DEAD-box RNA helicase polypeptide as described herein and optionally selecting for plants having enhanced yield-related traits.

In a preferred embodiment, the reduction or substantial elimination of expression of an endogenous DEAD-box RNA helicase gene and/or level and/or activity of an endogenous DEAD-box RNA helicase protein is obtained by introducing a DEAD-box RNA helicase nucleic acid or fragment thereof substantially homologous to said endogenous DEAD-box RNA helicase gene, more preferably said isolated nucleic acid is capable of forming a hairpin structure, further preferably the isolated nucleic acid is under the control of a constitutive promoter.

Concerning CER2-like polypeptides, according to a first embodiment, the present invention provides a method for enhancing yield-related traits in plants relative to control plants, comprising modulating expression in a plant of a nucleic acid encoding a CER2-like polypeptide and optionally selecting for plants having enhanced yield-related traits. Preferably, a method is provided for enhancing yield-related traits in plants relative to control plants, comprising modulating expression in a plant of a nucleic acid encoding a CER2-like polypeptide or a homologue thereof, wherein said CER2-like polypeptide or homologue thereof comprises a CER2-like related domain.

A preferred method for modulating, and preferably for increasing expression of a nucleic acid encoding a CER2-like polypeptide as provided herein or a homologue thereof is by introducing and expressing in a plant a nucleic acid encoding a CER2-like polypeptide or said homologue.

In an embodiment, a method is provided wherein said enhanced yield-related traits comprise increased yield relative to control plants, and preferably comprise increased seed yield and/or increased biomass relative to control plants.

In one embodiment a method is provided wherein said enhanced yield-related traits are obtained under non-stress conditions.

In another embodiment, a method is provided wherein said enhanced yield-related traits are obtained under conditions of osmotic stress, such as for instance drought stress, cold stress and/or salt stress, or under conditions of nitrogen deficiency.

Concerning At1g68440-like polypeptides, according to a first embodiment, the present invention provides a method for enhancing yield-related traits in plants relative to control plants, comprising modulating expression in a plant of a nucleic acid encoding an At1g68440-like polypeptide and optionally selecting for plants having enhanced yield-related traits.

A preferred method for modulating, preferably increasing, expression of a nucleic acid encoding an At1g68440-like polypeptide is by introducing and expressing in a plant a nucleic acid encoding an At1g68440-like polypeptide.

In one embodiment a "protein useful in the methods of the invention" is taken to mean a DEAD-box RNA helicase polypeptide as defined herein. Any reference hereinafter to a "nucleic acid useful in the methods of the invention" is taken to mean a nucleic acid capable of encoding such a DEAD-box RNA helicase polypeptide. The nucleic acid to be introduced into a plant (and therefore useful in performing the methods of the invention) is any nucleic acid encoding the type of protein which will now be described, hereafter also named "DEAD-box RNA helicase nucleic acid" or "DEAD-box RNA helicase gene".

A "DEAD-box RNA helicase polypeptide" as defined herein refers to any polypeptide comprising signature pattern [LIVMF]-[LIVMF]-D-E-A-D-[RKEN]-X-[LIVM-FYGSTN] (SEQ ID NO: 159).

Aubourg et al. (1999) proposed a relationship tree of 25 *A. thaliana* DEAD-box RNA helicase polypeptides (see FIG. 6). When analysed in that phylogenetic tree, DEAD-box RNA helicases tend to cluster together in 6 distinct subfamilies.

In a preferred embodiment, the DEAD-box RNA helicase polypeptide useful in the methods of the present invention, is an orthologue or paralogue to subfamily VI of the 6 subfamilies of DEAD-box RNA helicases as described by Aubourg et al. (1999).

In a more preferred embodiment, the DEAD-box RNA helicase polypeptide comprises one or more of the following MEME motifs:

```
                                               (SEQ ID NO: 3)
(i)   Motif 1: [LM][VI]ATDVA[AS]RGLD[IV][KP]D[VI]
               [EK]VV[IV]N[YF][SD][YF]P[LN][TD][IT]
               [ED]DYVHRIGRTGRA, (SEQ ID NO: 4)
(ii)  Motif 2: [RSN]L[NR][DR]V[TS][YF][LV]VLDEADRML
               DMGFEP[EQ][IV]R[AK]I[VL], (SEQ ID NO: 5)
(iii) Motif 3: P[TS]PIQA[YQ][AS][WI]P[YI][AL][LM]
               [DS]GRD[FL][IV][GA]IA[KA]TGSGKT
```

In an even more preferred embodiment, the DEAD-box RNA helicase polypeptide comprises one or more of the following MEME motifs:

```
                                               (SEQ ID NO: 6)
(i)   Motif 4: ATDVA[SA]RGLD[IV][KP]D[VI][EKR][VY]V
               [IV]NY[DS][YF]P[LT][TG][TLV]EDYVHRIG
               RTGR[TA]G[RAK][KT]G[VLT]A[HY]TFFT (SEQ ID NO: 7)
(ii)  Motif 5: [MS][GR][IV][CIT][RNS]L[NR][DRQE]V
               [ST][YF][LV]VLDEADRMLDMGFEP[QE][IV]
               R[KA]I[VL][SG][QE][TI][ARP][PS][VD]
               RQ[TM][LV]M[FWY][ST]ATWP
```

-continued (iii) Motif 6:  GF[ES][REK]P[ST]PIQ[AS][YQ][SAG]WP
                [YIMF][AL][LM][DKQ]GRD[FLI][IV][GA]
                IA [AKE]TGSGKT[IL][AG][FY][LG][VLI]
                P[AG][LFI][MV]H[VIL]
                (SEQ ID NO: 8)

Even more preferably, the DEAD-box RNA helicase polypeptide comprises one or more of the following MEME motifs:

(i) Motif 7:   [IV]ATDVA[AS]RGLDIPDVE[VY]VINY[ST]
               [YF]PLTTEDYVHRIGRTGRAGK[KT]G[VL]AH
               TFF
               (SEQ ID NO: 9)

(ii) Motif 8:  VLDEADRMLD[ML]GFEPE[VI]R[AS]I[LA]
               [GS]QT[ACR][SA][DV]RQ[MT]VMFSATWP
               [PL][AS]V[HQ][KQ]LAQEFMD
               (SEQ ID NO: 10)

(iii) Motif 9: VL[DE]C[CT]KGF[EQ][KR]PSPIQ[AS]
               [YHQ]AWP[YFI]LL[DS]GRD[FL][IV]GI
               AATGSGKT[LI]AFG[VI]PALMH[VI]
               (SEQ ID NO: 11)

Most preferably, the DEAD-box RNA helicase polypeptide comprises in increasing order of preference 1, 2, 3, 4, 5, 6, 7, or all of the motifs 10 to 17:

(i) motif 10:   FXXPSPIQ       (SEQ ID NO: 160)

(ii) motif 11:  AXTGSGKT       (SEQ ID NO: 161)

(iii) motif 12: PTRELAXQ       (SEQ ID NO: 162)

(iv) motif 13:  TPGR           (SEQ ID NO: 163)

(v) motif 14:   VLDEADRMLD     (SEQ ID NO: 164)

(vi) motif 15:  MFSATWP        (SEQ ID NO: 165)

(vii) motif 16: ATDVA[AS]RGLDI (SEQ ID NO: 166)

(viii) motif 17: RIGRTGRAG     (SEQ ID NO: 167)

In an alternative more preferred embodiment, the DEAD-box RNA helicase polypeptide comprises one motif from the group of motifs 1, 4 and 7 and/or one motif of the group of motifs 2, 5 and 8 and/or one motif of the group of motifs 3, 6 and 9.

Motifs 1 to 9 were derived using the MEME algorithm (Bailey and Elkan, Proceedings of the Second International Conference on Intelligent Systems for Molecular Biology, pp. 28-36, AAAI Press, Menlo Park, Calif., 1994). At each position within a MEME motif, the residues are shown that are present in the query set of sequences with a frequency higher than 0.2. Residues within square brackets represent alternatives.

Motifs 10 to 17 were derived from the multiple alignment as shown in FIG. 2. Motifs 10 to 17 are highly conserved motifs in the DEAD-box RNA helicase polypeptides. From the alignment of FIG. 2 more conserved regions can be deduced.

Additionally or alternatively, the homologue of a DEAD-box RNA helicase protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a DEAD-box RNA helicase polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 3 to SEQ ID NO: 11. More preferably the motifs in a DEAD-box RNA helicase polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 160 to SEQ ID NO: 167.

In another embodiment a "protein useful in the methods of the invention" is taken to mean a CER2-like polypeptide as defined herein. Any reference hereinafter to a "nucleic acid useful in the methods of the invention" is taken to mean a nucleic acid capable of encoding such a CER2-like polypeptide. The nucleic acid to be introduced into a plant (and therefore useful in performing the methods of the invention) is any nucleic acid encoding the type of protein which will now be described, hereafter also named "CER2-like nucleic acid" or "CER2-like gene".

A "CER2-like polypeptide" as defined herein refers to any Pfam PF02458 domain containing protein or polypeptide belonging to acyltransferase family. These proteins are involved in multiple biosynthetic pathways including, but not limited to, phytoalexin, vindoline and cuticular wax biosynthesis as well as detoxification of toxic metabolites. Said acyltransferase falls in two main categories:

Clade A members, including *Arabidopsis* CER2 and corn glossy 2, which are potentially involved in wax biosynthesis (see FIG. 9), DAT-like acyl transferase represented by clade B members (see FIG. 9) and characterized by a conserved D[FL]G[GW]Gx[PE] motif.

Enzymes having said activity, for example, include: anthranilate N-hydroxycinnamoyl/benzoyltransferase, deacetylvindoline 4-O-acetyltransferase (DAT, EC:2.3.1.107) involved in the last step in vindoline biosynthesis. More particular, this subfamily is characterized by a HxxxDG triad and a DFGWGKP consensus sequence. Also included in this family is, for example, Trichothecene 3-O-acetyltransferase which is involved in the detoxification of trichothecene. These polypeptides have been previously described to be involved in cuticular wax biosynthesis in plants, as described supra. The term "CER2-like polypeptide" as used herein also intends to include homologues as defined hereunder of "CER2-like polypeptides".

In a preferred embodiment, a CER2-like polypeptide as applied herein comprises a CER2-like related domain. In a preferred embodiment, the CER2-like related domain corresponds to Pfam PF02458.

In a preferred embodiment, the CER2-like polypeptide comprises one or more of the following motifs:

```
i) Motif 18a:
                              (SEQ ID NO: 274)
   FKCGGL[SA][LI]G[LV][SG]W[AS]HI[LV][GA]D[GA]F
   SASHFIN[SA]W.

Preferably said motif is
                    (motif 18b; SEQ ID NO: 275)
   FKCGGLSVGLSWAHILGDAFSAFNFITKWSHILAGQSQPKS ii) Motif 19a:
                              (SEQ ID NO: 276)
    SRG[PL]E[IVL]KCNDEG[VA][RL][FI][VI]EAE[CA]D.

Pregerably, said motif is
                    (motif 19b; SEQ ID NO: 277)
    SGRPFIKCNDAGVRIAESQCDK;

iii) Motif 20a:
                              (SEQ ID NO: 278)
     xY[ST][TR][FY]E[AI]L[AST][AG][HL][IV]W[RK]
     [CS]I[AC]KARG.

Preferably, said motif is
                     (motif 20b; SEQ ID NO: 279)
     DTKYFEIISATIWKCIAQIRG.
```

In one preferred embodiment, the CER2-like polypeptide comprises also one or more of the following motifs:

```
i) Motif 21a:
                              (SEQ ID NO: 280)
   VQ[VF]TxFKCGG[LM][SA][LIV]GLS[WC]AH[IVL]LGD
   [APV]FSA[ST]TF[FIM][NK]KW.

Preferably said motif is:
                    (motif 21b; SEQ ID NO: 281)
   VFVKFTSFKCGGLSVGLSWAHILGDAFSAFNFITKW;

ii) Motif 22a:
                              (SEQ ID NO: 282)
    [EA]SGR[PW][YF][IV]KCND[AC]GVRIVEA[KHR]CDK.

Preferably said motif is:
                    (motif 22b; SEQ ID NO: 283)
    KSGFPFIKCNDAGVRIAESQCDK;

iii) Motif 23a:
                              (SEQ ID NO: 284)
     SR[VT][GE][EP][GN]Kx[HY]E[LP][ST]x[LM]DLAM
     KLHY[LVI]R[GA]VY[FY][FY].

Preferably said motif is:
                     (motif 23b; SEQ ID NO: 285)
     GEHNLNYMDLLMKLHY;
```

These motifs 18 to 23 are essentially present in CER2-like polypeptides of the Clade A group of polypeptides as described herein.

In yet another preferred embodiment, the CER2-like polypeptide comprises also one or more of the following motifs:

```
i) Motif 24:
                              (SEQ ID NO: 286)
   FKCGG[VIF][SA][LI]G[VL]G[MI]SHx[VLM]ADGxSALHF
   [NS][SAT]W.

ii) Motif 25:
                              (SEQ ID NO: 287)
    NPNLL[IV][TV]SWT[RT][LF]P[ILF][YH][DE]ADFGWG
    [KR]PI[FY]MGP;

iii) Motif 26:
                              (SEQ ID NO: 288)
     [SA]LS[KE][VT]L[VT][HP][FY]YP[ML]AGR;
```

These additional motifs 7 to 9 are essentially present in CER2-like polypeptides of the DAT-like acyl transferase represented by clade B members as described herein.

As used herein, the letter "x" means any amino acid and [AB] means either A or B amino acid is possible at this position.

Motifs 18 to 26 were derived using the MEME algorithm (Bailey and Elkan, Proceedings of the Second International Conference on Intelligent Systems for Molecular Biology, pp. 28-36, AAAI Press, Menlo Park, Calif., 1994). At each position within a MEME motif, the residues are shown that are present in the query set of sequences with a frequency higher than 0.2. Residues within square brackets represent alternatives.

More preferably, the CER2-like polypeptide comprises in increasing order of preference, at least 2, at least 3, at least 4, at least 5, at least 6, at least 7, at least 8, or all 9 motifs selected from the group comprising motifs 18a, 19a, 20a, 21a, 22a, 23a, 24, 25, and 26. In an even more preferred embodiment, the CER2-like polypeptide comprises at least 2, at least 3, at least 4, at least 5, or all 6 motifs selected from the group comprising motifs 18a, 19a, 20a, 21a, 22a, 23a. In a particularly preferred embodiment, the CER2-like polypeptide comprises at least 2, at least 3, at least 4, at least 5, or all 6 motifs selected from the group comprising motifs 18b, 19b, 20b, 21b, 22b, 23b.

Additionally or alternatively, the homologue of a CER2-like protein has in increasing order of preference at least 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 169, provided that the homologous protein comprises any one or more of the conserved Motifs 18 to 26 as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a CER2-like polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 274 to SEQ ID NO: 285 (Motifs 18 to 23).

In other words, in another embodiment a method is provided wherein said CER2-like polypeptide comprises a conserved domain (or motif) with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a conserved domain of amino acid coordinates 73 to 189 of SEQ ID NO: 169).

Any reference hereinafter to a "protein useful in the methods of the invention" is taken to mean an At1g68440-like polypeptide as defined herein. Any reference hereinafter to a "nucleic acid useful in the methods of the invention" is taken to mean a nucleic acid capable of encoding such an At1g68440-like polypeptide. The nucleic acid to be introduced into a plant (and therefore useful in performing the methods of the invention) is any nucleic acid encoding the type of protein which will now be described, hereafter also named "At1g68440-like nucleic acid" or "At1g68440-like gene".

A "At1g68440-like polypeptide" preferably comprises a transmembrane domain.

The terms "domain", "signature", and "motif" are defined in the definitions section herein.

In a preferred embodiment, the At1g68440-like polypeptide comprises one or more of the following motifs:

i) Motif 27a:
                                        (SEQ ID NO: 364)
    Y[SN]F[WC][KT]WGALILA[LV][FVL]A.

Preferably said motif is
                    (motif 26b; SEQ ID NO: 365)
    YSFWKWGALILALAA.

ii) Motif 28a:
                                        (SEQ ID NO: 366)
    ME[IV][PT][VE][IL]N[RL]I[SG]DF.

Preferably, said motif is
                    (motif 28b; SEQ ID NO: 367)
    MEIPVINRISDF;

iii) Motif 29a:
                                        (SEQ ID NO: 368)
    [SN]VV[KQ]LWD[SN]LG[LF].

Preferably, said motif is
                    (motif 29b; SEQ ID NO: 369)
    NVVKLWDNLGL.

In one preferred embodiment, the At1g68440-like polypeptide comprises also one or more of the following motifs:

i) Motif 30a:
                                        (SEQ ID NO: 370)
    SQ[VI][SL]A[LV]SG[IV][GE]K[FI][YH]Q[AT]Y
    [NSH][FL]WKWGALILAL[IAV]ASF[TS]IINR[VI]K
    [AI]L[IV][KR][LF][QK][KN]HP.

Preferably said motif is:
                    (motif 30b; SEQ ID NO: 371)
    SQILALSGVEKIHQAYSFWKWGALILALAASFTAIINRIK
    LIIRFKNHP;

ii) Motif 31a:
                                        (SEQ ID NO: 372)
    [MDE][MF]T[SN]GK[NS]VVKLWDNLGLG[LF]G.

Preferably said motif is:
                    (motif 31b; SEQ ID NO: 373)
    DFTNGKNVVKLWDNLGLSLGL;

iii) Motif 32a:
                                        (SEQ ID NO: 374)
    MEI[LP]V[IV]NRI[IS]DFE[TA][NGS][IL][NAS]
    [PS][SL][LQ][VN].

Preferably said motif is:
                    (motif 32b; SEQ ID NO: 375)
    MEIPVINRISDFETGLASLQN;

These motifs 27 to 32 are essentially present in At1g68440-like polypeptides of the Clade A group of polypeptides as described herein.

As used herein, the letter "x" means any amino acid and [AB] means either A or B amino acid is possible at this position.

Motifs 1 to 6 were derived using the MEME algorithm (Bailey and Elkan, Proceedings of the Second International Conference on Intelligent Systems for Molecular Biology, pp. 28-36, AAAI Press, Menlo Park, Calif., 1994). At each position within a MEME motif, the residues are shown that are present in the query set of sequences with a frequency higher than 0.2. Residues within square brackets represent alternatives.

More preferably, the At1g68440-like polypeptide comprises in increasing order of preference, at least 2, at least 3, at least 4, at least 5, or all 6 motifs, selected from the group comprising motifs 27a, 28a, 29a, 30a, 31a, and 32a. In a particularly preferred embodiment, the At1g68440-like polypeptide comprises at least 2, at least 3, at least 4, at least 5, or all 6 motifs selected from the group comprising motifs 27b, 28b, 29b, 30b, 31b, and 32b.

The term "At1g68440-like polypeptide" as used herein also intends to include homologues as defined hereunder of "At1g68440-like polypeptide".

Additionally or alternatively, the homologue of an At1g68440-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 292, provided that the homologous protein comprises any one or more of the conserved motifs 27 to 32 as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in an At1g68440-like polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 370 to SEQ ID NO: 375 (Motifs 27 to 32).

In other words, in another embodiment a method is provided wherein said At1g68440-like polypeptide comprises a transmembrane domain with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a conserved domain of amino acid coordinates 46 to 64 of SEQ ID NO: 292.

The terms "domain", "signature" and "motif" are defined in the "definitions" section herein.

Concerning DEAD-box RNA helicase polypeptides, preferably, the polypeptide sequence which when used in the construction of a phylogenetic tree, such as the one depicted in FIG. 3, clusters with the group of DEAD-box RNA helicase polypeptides (preferably of subgroup VI as defined by Aubourg et al. (1999)) comprising the amino acid sequence represented by SEQ ID NO: 2 rather than with any other group.

Furthermore, DEAD-box RNA helicase polypeptides (at least in their native form) typically have RNA unwinding activity. Tools and techniques for measuring helicase activity are well known in the art, e.g. Okanami et al. (1998) Nucleic Acid Res. (26): 2638-2643.

In addition, DEAD-box RNA helicase polypeptides, when reduced or substantially eliminated in transgenic plants such as e.g. rice according to the methods of the present invention as outlined in The Examples section, give plants having increased yield related traits, in particular increased seed yield.

Concerning CER2-like polypeptides, preferably, the polypeptide sequence which when used in the construction of a phylogenetic tree, such as the one depicted in FIG. 9, clusters with the group of CER2-like polypeptides of Clade A comprising the amino acid sequence represented by SEQ ID NO: 167 rather than with any other group.

Furthermore, CER2-like polypeptides (at least in their native form) typically have acyltransferase activity. Tools and techniques for measuring acyltransferase activity are well known in the art. Preferably, the CER2-like polypeptide belongs to EC 2.3.1. Depending on the type of acyltransferase, assays are available in the art to measure such an activity. As an example, Power et al., 1985, (Archives of Biochemistry and Biophysics, Vol. 279, pages 370-376) describes how Deacetylvindoline 4-O-acetyltransferase activity can be determined. Further details are provided in the Examples section.

In addition, CER2-like polypeptides, when expressed in rice according to the methods of the present invention as outlined in the Examples section, give plants having increased yield related traits, in particular increased total weight of seeds, increased seed fill rate, increased harvest index, increased number of filled seeds.

Concerning At1g68440-like polypeptides, preferably, the polypeptide sequence which when used in the construction of a phylogenetic tree, such as the one depicted in FIG. 14, clusters with the group of At1g68440-like polypeptides of Clade A comprising the amino acid sequence represented by SEQ ID NO: 292 rather than with any other group.

In addition, At1g68440-like polypeptides, when expressed in rice according to the methods of the present invention as outlined in the Examples section, give plants having increased yield related traits, in particular increased seed yield, number of filled seeds, seed fillrate, total seed weight or HarvestIndex.

Concerning DEAD-box RNA helicase polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any DEAD-box RNA helicase-encoding nucleic acid or DEAD-box RNA helicase polypeptide as defined herein, provided this DEAD-box RNA helicase gene reduces or substantially eliminates expression of the endogenous DEAD-box RNA helicase polypeptide.

Examples of nucleic acids encoding DEAD-box RNA helicase polypeptides are given in Table A1 of the Examples section herein. Such nucleic acids are useful in performing the methods of the invention. The amino acid sequences given in Table A1 of the Examples section are example sequences of orthologues and paralogues of the DEAD-box RNA helicase polypeptide represented by SEQ ID NO: 2, the terms "orthologues" and "paralogues" being as defined herein. Further orthologues and paralogues may readily be identified by performing a so-called reciprocal blast search as described in the definitions section; where the query sequence is SEQ ID NO: 1 or SEQ ID NO: 2, the second BLAST (back-BLAST) would be against rice sequences.

The invention also provides hitherto unknown DEAD-box RNA helicase-encoding nucleic acids and DEAD-box RNA helicase polypeptides useful for conferring enhanced yield-related traits in plants relative to control plants.

According to a further embodiment of the present invention, there is therefore provided an isolated nucleic acid molecule selected from:

(i) a nucleic acid represented by SEQ ID NO: 12 or 14;
(ii) the complement of a nucleic acid represented by SEQ ID NO: 12 or 14;
(iii) a nucleic acid encoding a DEAD-box RNA helicase polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 13 or 15, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 3 to SEQ ID NO: 11, and further preferably conferring enhanced yield-related traits relative to control plants.
(iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:

(i) an amino acid sequence represented by SEQ ID NO: 13 or 15;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 13 or 15, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 3 to SEQ ID NO: 11, and further preferably conferring enhanced yield-related traits relative to control plants;

(iii) derivatives of any of the amino acid sequences given in (i) or (ii) above.

Concerning CER2-like polypeptides, the present invention is illustrated by transforming plants with the nucleic acid sequence represented by SEQ ID NO: 168, encoding the polypeptide sequence of SEQ ID NO: 169. However, performance of the invention is not restricted to these sequences; the methods of the invention may advantageously be performed using any CER2-like-encoding nucleic acid or CER2-like polypeptide as defined herein.

Examples of nucleic acids encoding CER2-like polypeptides are given in Table A2 of the Examples section herein. Such nucleic acids are useful in performing the methods of the invention. The amino acid sequences given in Table A2 of the Examples section are example sequences of orthologues and paralogues of the CER2-like polypeptide represented by SEQ ID NO: 169, the terms "orthologues" and "paralogues" being as defined herein. Further orthologues and paralogues may readily be identified by performing a so-called reciprocal blast search as described in the definitions section; where the query sequence is SEQ ID NO: 168 or SEQ ID NO: 169, the second BLAST (back-BLAST) would be against alfalfa sequences.

The invention also provides hitherto unknown CER2-like-encoding nucleic acids and CER2-like polypeptides useful for conferring enhanced yield-related traits in plants relative to control plants.

According to a further embodiment of the present invention, there is therefore provided an isolated nucleic acid molecule selected from:

(i) a nucleic acid represented by SEQ ID NO: 168;

(ii) the complement of a nucleic acid represented by SEQ ID NO: 168;

(iii) a nucleic acid encoding a CER2-like polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 169 and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 274 to SEQ ID NO: 288, and further preferably conferring enhanced yield-related traits relative to control plants.

(iv) a nucleic acid molecule which hybridizes with a nucleic acid molecule of (i) to (iii) under high stringency hybridization conditions and preferably confers enhanced yield-related traits relative to control plants.

(v) a nucleic acid encoding a CER2-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 169 and any of the other amino acid sequences in Table A2 and preferably conferring enhanced yield-related traits relative to control plants.

According to a further embodiment of the present invention, there is also provided an isolated polypeptide selected from:

(i) an amino acid sequence represented by SEQ ID NO: 169;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 169, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 274 to SEQ ID NO: 288, and further preferably conferring enhanced yield-related traits relative to control plants;

(iii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by (any one of) SEQ ID NO: 169 and any of the other amino acid sequences in Table A2 and preferably conferring enhanced yield-related traits relative to control plants;

(iv) derivatives of any of the amino acid sequences given in (i) or (iii) above.

Concerning At1g68440-like polypeptides, the present invention is illustrated by transforming plants with the nucleic acid sequence represented by SEQ ID NO: 291, encoding the polypeptide sequence of SEQ ID NO: 292. However, performance of the invention is not restricted to these sequences; the methods of the invention may advantageously be performed using any At1g68440-like-encoding nucleic acid or At1g68440-like polypeptide as defined herein.

Examples of nucleic acids encoding At1g68440-like polypeptides are given in Table A3 of the Examples section herein. Such nucleic acids are useful in performing the methods of the invention. The amino acid sequences given in Table A3 of the Examples section are example sequences of orthologues and paralogues of the At1g68440-like polypeptide represented by SEQ ID NO: 292, the terms "orthologues" and "paralogues" being as defined herein. Further orthologues and paralogues may readily be identified by performing a so-called reciprocal blast search as described in the definitions section; where the query sequence is SEQ ID NO: 291 or SEQ ID NO: 292, the second BLAST (back-BLAST) would be against poplar sequences.

The invention also provides hitherto unknown At1g68440-like-encoding nucleic acids and At1g68440-like polypeptides useful for conferring enhanced yield-related traits in plants relative to control plants.

According to a further embodiment of the present invention, there is therefore provided an isolated nucleic acid molecule selected from:

(i) a nucleic acid represented by SEQ ID NO: 291;
(ii) the complement of a nucleic acid represented by SEQ ID NO: 291;
(iii) a nucleic acid encoding an At1g68440-like polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 292, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 364 to SEQ ID NO: 375, and further preferably conferring enhanced yield-related traits relative to control plants.
(iv) a nucleic acid molecule which hybridizes with a nucleic acid molecule of (i) to (iii) under high stringency hybridization conditions and preferably confers enhanced yield-related traits relative to control plants.
(v) a nucleic acid encoding an At1g68440-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 292 and any of the other amino acid sequences in Table A3 and preferably conferring enhanced yield-related traits relative to control plants.

According to a further embodiment of the present invention, there is also provided an isolated polypeptide selected from:

(i) an amino acid sequence represented by SEQ ID NO: 292;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 2, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 364 to SEQ ID NO: 375, and/or any of the other amino acid sequences in Table A3, and further preferably conferring enhanced yield-related traits relative to control plants;
(iii) derivatives of any of the amino acid sequences given in (i) or (ii) above.

Nucleic acid variants may also be useful in practising the methods of the invention. Examples of such variants include nucleic acids encoding homologues and derivatives of any one of the amino acid sequences given in Table A1 to A3 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A3 of the Examples section. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Further nucleic acid variants useful in practising the methods of the invention include portions of nucleic acids encoding DEAD-box RNA helicase polypeptides, or CER2-like polypeptides, or At1g68440-like polypeptides, nucleic acids hybridising to nucleic acids encoding DEAD-box RNA helicase polypeptides, or CER2-like polypeptides, or At1g68440-like polypeptides, splice variants of nucleic acids encoding DEAD-box RNA helicase polypeptides, or CER2-like polypeptides, or At1g68440-like polypeptides, allelic variants of nucleic acids encoding DEAD-box RNA helicase polypeptides, or CER2-like polypeptides, or At1g68440-like polypeptides and variants of nucleic acids encoding DEAD-box RNA helicase polypeptides, or CER2-like polypeptides, or At1g68440-like polypeptides obtained by gene shuffling. The terms hybridising sequence, splice variant, allelic variant and gene shuffling are as described herein.

Nucleic acids encoding DEAD-box RNA helicase polypeptides, or CER2-like polypeptides, or At1g68440-like polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A3 of the Examples section, or a portion of a nucleic acid encoding an orthologue, paralogue or homologue of any of the amino acid sequences given in Table A1 to A3 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning DEAD-box RNA helicase polypeptides, portions useful in the methods of the invention, encode a DEAD-box RNA helicase polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 10, 15, 20, 25, 30, 35, 40, 45, 50, 100, 150, 200, 250, 300, 350, 400, 450, 500, 550, 600, 650, 700, 750, 800, 850, 900, 950, 1000, 1050, 1100, 1150, 1200, 1250 consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence which, when used in the construction of a phylogenetic tree, such as the one depicted in FIG. 3, clusters with the group of DEAD-box RNA helicase polypeptides (more preferably, subfamily VI as described by Aubourg et al. (1999)) comprising the amino acid sequence represented by SEQ ID NO: 2 rather than with any other group and/or comprises any one of the motifs 1 to 9 as described above and/or has helicase activity and/or has at least 45% sequence identity to SEQ ID NO: 2.

Another nucleic acid variant useful in the methods of the invention is a nucleic acid capable of hybridising, under reduced stringency conditions, preferably under stringent conditions, with a nucleic acid encoding a DEAD-box RNA helicase polypeptide as defined herein, or with a portion as defined herein.

Concerning CER2-like polypeptides, portions useful in the methods of the invention, encode a CER2-like polypeptide as defined herein, and have substantially the same biological activity as the amino acid sequences given in Table A2 of the Examples section. Preferably, the portion is a portion of any one of the nucleic acids given in Table A2 of the Examples section, or is a portion of a nucleic acid encoding an orthologue or paralogue of any one of the amino acid sequences given in Table A2 of the Examples section. Preferably the portion is at least 500, 550, 600, 650, 700, 750, 800, 850, 900, 950, 1000, 1500, 2000, consecutive nucleotides in length, the consecutive nucleotides being of any one of the nucleic acid sequences given in Table A2 of the Examples section, or of a nucleic acid encoding an orthologue or paralogue of any one of the amino acid sequences given in Table A2 of the Examples section. Most preferably the portion is a portion of the nucleic acid of SEQ ID NO: 168. Preferably, the portion encodes a fragment of an amino acid sequence which, when used in the construction of a phylogenetic tree, such as the one depicted in FIG. 9, clusters with the group of CER2-like polypeptides of Clade A comprising the amino acid sequence represented by SEQ ID NO: 169 rather than with any other group and/or comprises at least, 2, at least 3, at least 4, at least 5, at least 6, at least 7, at least 8, or all 9 motifs 18a, 19a, 20a, 21a, 22a, 23a, 24, 25, or 26 and/or has biological activity of acyltransferases.

Another nucleic acid variant useful in the methods of the invention is a nucleic acid capable of hybridising, under reduced stringency conditions, preferably under stringent conditions, with a nucleic acid encoding a CER2-like polypeptide as defined herein, or with a portion as defined herein.

Concerning At1g68440-like polypeptides, portions useful in the methods of the invention, encode an At1g68440-like polypeptide as defined herein, and have substantially the same biological activity as the amino acid sequences given in Table A3 of the Examples section. Preferably, the portion is a portion of any one of the nucleic acids given in Table A3 of the Examples section, or is a portion of a nucleic acid encoding an orthologue or paralogue of any one of the amino acid sequences given in Table A3 of the Examples section. Preferably the portion is at least 500, 550, 600, 650, 700, 750, 800, 850, 900, 950, 1000, 1050, 1100 consecutive nucleotides in length, the consecutive nucleotides being of any one of the nucleic acid sequences given in Table A3 of the Examples section, or of a nucleic acid encoding an orthologue or paralogue of any one of the amino acid sequences given in Table A3 of the Examples section. Most preferably the portion is a portion of the nucleic acid of SEQ ID NO: 291. Preferably, the portion encodes a fragment of an amino acid sequence which, when used in the construction of a phylogenetic tree, such as the one depicted in FIG. 14, clusters with the group of At1g68440-like polypeptides of Clade A comprising the amino acid sequence represented by SEQ ID NO: 292 rather than with any other group and/or comprises at least, 2, at least 3, at least 4, at least 5, or all 6 motifs selected from 27a, 28a, 29a, 30a, 34a, 35a.

Another nucleic acid variant useful in the methods of the invention is a nucleic acid capable of hybridising, under reduced stringency conditions, preferably under stringent conditions, with a nucleic acid encoding an At1g68440-like polypeptide as defined herein, or with a portion as defined herein.

According to the present invention, there is provided a method for enhancing yield-related traits in plants, comprising reducing or substantially eliminating expression in a plant a nucleic acid capable of hybridizing to any one of the nucleic acids given in Table A1 to A3 of the Examples section, or comprising introducing and expressing in a plant a nucleic acid capable of hybridising to a nucleic acid encoding an orthologue, paralogue or homologue of any of the nucleic acid sequences given in Table A1 to A3 of the Examples section.

Concerning DEAD-box RNA helicase polypeptides, hybridising sequences useful in the methods of the invention encode a DEAD-box RNA helicase polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to a portion thereof.

Preferably, the hybridising sequence encodes a polypeptide with an amino acid sequence which, when full-length and used in the construction of a phylogenetic tree, such as the one depicted in FIG. 3, clusters with the group of DEAD-box RNA helicase polypeptides (more preferably, subfamily VI as described by Aubourg et al. (1999)) comprising the amino acid sequence represented by SEQ ID NO: 2 rather than with any other group AND/OR comprises any one of the motifs 1 to 9 as described above AND/OR has helicase activity AND/OR has at least 45% sequence identity to SEQ ID NO: 2.

Concerning CER2-like polypeptides, hybridising sequences useful in the methods of the invention encode a CER2-like polypeptide as defined herein, having substantially the same biological activity as the amino acid sequences given in Table A2 of the Examples section. Preferably, the hybridising sequence is capable of hybridising to the complement of any one of the nucleic acids given in Table A2 of the Examples section, or to a portion of any of these sequences, a portion being as defined above, or the hybridising sequence is capable of hybridising to the complement of a nucleic acid encoding an orthologue or paralogue of any one of the amino acid sequences given in Table A2 of the Examples section. Most preferably, the hybridising sequence is capable of hybridising to the complement of a nucleic acid as represented by SEQ ID NO: 168 or to a portion thereof.

Preferably, the hybridising sequence encodes a polypeptide with an amino acid sequence which, when used in the construction of a phylogenetic tree, such as the one depicted in FIG. 9, clusters with the group of CER2-like polypeptides of Clade A comprising the amino acid sequence represented by SEQ ID NO: 169 rather than with any other group and/or comprises at least, 2, at least 3, at least 4, at least 5, at least 6, at least 7, at least 8, or all 9 motifs 18a, 19a, 20a, 21a, 22a, 23a, 24, 25, or 26 and/or has biological activity of acyltransferases.

Concerning At1g68440-like polypeptides, hybridising sequences useful in the methods of the invention encode an At1g68440-like polypeptide as defined herein, having substantially the same biological activity as the amino acid sequences given in Table A3 of the Examples section. Preferably, the hybridising sequence is capable of hybridising to the complement of any one of the nucleic acids given in Table A3 of the Examples section, or to a portion of any of these sequences, a portion being as defined above, or the hybridising sequence is capable of hybridising to the complement of a nucleic acid encoding an orthologue or paralogue of any one of the amino acid sequences given in Table A3 of the Examples section. Most preferably, the hybridising sequence is capable of hybridising to the complement of a nucleic acid as represented by SEQ ID NO: 291 or to a portion thereof.

Preferably, the hybridising sequence encodes a polypeptide with an amino acid sequence which, when full-length and used in the construction of a phylogenetic tree, such as the one depicted in FIG. 14, clusters with the group of At1g68440-like polypeptides of Clade A comprising the amino acid sequence represented by SEQ ID NO: 292 rather than with any other group and/or comprises at least, 2, at least 3, at least 4, at least 5, or all 6 motifs selected from 27a, 28a, 29a, 30a, 31a, 32a.

Another nucleic acid variant useful in the methods of the invention is a splice variant encoding a DEAD-box RNA helicase polypeptide, or a CER2-like (CER2-like acyl transferase) polypeptide, or an At1g68440-like polypeptide as defined hereinabove, a splice variant being as defined herein.

According to the present invention, there is provided a method for enhancing yield-related traits in plants, comprising reducing or substantially eliminating expression in a plant of a splice variant of any one of the nucleic acid sequences given in Table A1 to A3 of the Examples section, or a splice variant of a nucleic acid encoding an orthologue, paralogue or homologue of any of the amino acid sequences given in Table A1 to A3 of the Examples section.

Concerning DEAD-box RNA helicase polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 3, clusters with the group of DEAD-box RNA helicase polypeptides (more preferably, subfamily VI as described by Aubourg et al. (1999)) comprising the amino acid sequence represented by SEQ ID NO: 2 rather than with any other group and/or comprises any one of the motifs 1 to 9 as described above and/or has helicase activity and/or has at least 45% sequence identity to SEQ ID NO: 2.

Concerning CER2-like polypeptides, preferred splice variants are splice variants of a nucleic acid represented by SEQ ID NO: 168, or a splice variant of a nucleic acid encoding an orthologue or paralogue of SEQ ID NO: 169. Preferably, the amino acid sequence encoded by the splice variant which, when used in the construction of a phylogenetic tree, such as the one depicted in FIG. 9, clusters with the group of CER2-like polypeptides of Clade A comprising the amino acid sequence represented by SEQ ID NO: 169 rather than with any other group and/or comprises at least, 2, at least 3, at least 4, at least 5, at least 6, at least 7, at least 8, or all 9 motifs 18a, 19a, 20a, 21a, 22a, 23a, 24, 25, or 26 and/or has biological activity of acyltransferases.

Concerning At1g68440-like polypeptides, preferred splice variants are splice variants of a nucleic acid represented by SEQ ID NO: 291, or a splice variant of a nucleic acid encoding an orthologue or paralogue of SEQ ID NO: 292. Preferably, the amino acid sequence encoded by the splice variant, when used in the construction of a phylogenetic tree, such as the one depicted in FIG. 14, clusters with the group of At1g68440-like polypeptides of Clade A comprising the amino acid sequence represented by SEQ ID NO: 292 rather than with any other group and/or comprises at least, 2, at least 3, at least 4, at least 5, or all 6 motifs selected from 27a, 28a, 29a, 30a, 31a, 32a.

Another nucleic acid variant useful in performing the methods of the invention is an allelic variant of a nucleic acid encoding a DEAD-box RNA helicase polypeptide, or a CER2-like (CER2-like acyl transferase) polypeptide, or an At1g68440-like polypeptide as defined hereinabove, an allelic variant being as defined herein.

According to the present invention, there is provided a method for enhancing yield-related traits in plants, comprising reducing or substantially eliminating expression in a plant of an allelic variant of any one of the nucleic acids given in Table A1 to A3 of the Examples section, or comprising reducing or substantially eliminating expression in a plant an allelic variant of a nucleic acid encoding an orthologue, paralogue or homologue of any of the amino acid sequences given in Table A1 to A3 of the Examples section.

Concerning DEAD-box RNA helicase polypeptides, the polypeptides encoded by allelic variants useful in the methods of the present invention have substantially the same biological activity as the DEAD-box RNA helicase polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 3, clusters with the group of DEAD-box RNA helicase polypeptides (more preferably, subfamily VI as described by Aubourg et al. (1999)) comprising the amino acid sequence represented by SEQ ID NO: 2 rather than with any other group and/or comprises any one of the motifs 1 to 9 as described above and/or has helicase activity and/or has at least 45% sequence identity to SEQ ID NO: 2.

Concerning CER2-like polypeptides, the polypeptides encoded by allelic variants useful in the methods of the present invention have substantially the same biological activity as the CER2-like polypeptide of SEQ ID NO: 169 and any of the amino acids depicted in Table A2 of the Examples section. Allelic variants exist in nature, and encompassed within the methods of the present invention is the use of these natural alleles. Preferably, the allelic variant is an allelic variant of SEQ ID NO: 168 or an allelic variant of a nucleic acid encoding an orthologue or paralogue of SEQ ID NO: 169. Preferably, the amino acid sequence encoded by the allelic variant which, when used in the construction of a phylogenetic tree, such as the one depicted in FIG. 9, clusters with the group of CER2-like polypeptides of Clade A comprising the amino acid sequence represented by SEQ ID NO: 169 rather than with any other group and/or comprises at least, 2, at least 3, at least 4, at least 5, at least 6, at least 7, at least 8, or all 9 motifs 18a, 19a, 20a, 21a, 22a, 23a, 24, 25, or 26 and/or has biological activity of acyl-transferases.

Concerning At1g68440-like polypeptides, the polypeptides encoded by allelic variants useful in the methods of the present invention have substantially the same biological activity as the At1g68440-like polypeptide of SEQ ID NO: 292 and any of the amino acids depicted in Table A3 of the Examples section. Allelic variants exist in nature, and encompassed within the methods of the present invention is the use of these natural alleles. Preferably, the allelic variant is an allelic variant of SEQ ID NO: 291 or an allelic variant of a nucleic acid encoding an orthologue or paralogue of SEQ ID NO: 292. Preferably, the amino acid sequence encoded by the allelic variant, when used in the construction of a phylogenetic tree, such as the one depicted in FIG. 14, clusters with the group of At1g68440-like polypeptides of Clade A comprising the amino acid sequence represented by SEQ ID NO: 292 rather than with any other group and/or comprises at least, 2, at least 3, at least 4, at least 5, or all 6 motifs selected from 27a, 28a, 29a, 30a, 31a, 32a.

Gene shuffling or directed evolution may also be used to generate variants of nucleic acids encoding DEAD-box RNA helicase polypeptides, or CER2-like polypeptides, or At1g68440-like polypeptides as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A3 of the Examples section, or comprising introducing and expressing in a plant a variant of a nucleic acid encoding an orthologue, paralogue or homologue of any of the amino acid sequences given in Table A1 to A3 of the Examples section, which variant nucleic acid is obtained by gene shuffling.

Concerning DEAD-box RNA helicase polypeptides, preferably, the amino acid sequence encoded by the variant nucleic acid obtained by gene shuffling, when used in the construction of a phylogenetic tree such as the one depicted in FIG. 3, clusters with the group of DEAD-box RNA helicase polypeptides (more preferably, subfamily VI as described by Aubourg et al. (1999)) comprising the amino acid sequence represented by SEQ ID NO: 2 rather than with any other group and/or comprises any one of the motifs 1 to 9 as described above and/or has helicase activity and/or has at least 45% sequence identity to SEQ ID NO: 2.

Concerning CER2-like polypeptides, preferably, the amino acid sequence encoded by the variant nucleic acid obtained by gene shuffling, when used in the construction of a phylogenetic tree, such as the one depicted in FIG. 9, clusters with the group of CER2-like polypeptides of Clade A comprising the amino acid sequence represented by SEQ ID NO: 169 rather than with any other group and/or comprises at least, 2, at least 3, at least 4, at least 5, at least 6, at least 7, at least 8, or all 9 motifs 18a, 19a, 20a, 21a, 22a, 23a, 24, 25, or 26 and/or has biological activity of acyl-transferases.

Concerning At1g68440-like polypeptides, preferably, the amino acid sequence encoded by the variant nucleic acid obtained by gene shuffling, when used in the construction of a phylogenetic tree such as the one depicted in FIG. 14, clusters with the group of At1g68440-like polypeptides of Clade A comprising the amino acid sequence represented by SEQ ID NO: 292 rather than with any other group and/or comprises at least, 2, at least 3, at least 4, at least 5, or all 6 motifs selected from 27a, 28a, 29a, 30a, 31a, 32a.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding DEAD-box RNA helicase polypeptides may be derived from any natural or artificial source. The nucleic acid may be modified from its native form in composition and/or genomic environment through deliberate human manipulation. Preferably the DEAD-box RNA helicase polypeptide-encoding nucleic acid is from a plant, further preferably from a monocotyledonous plant, more preferably from the family Poaceae, most preferably the nucleic acid is from *Oryza sativa*. In an alternative preferred embodiment the nucleic acid is from *Zea mays*.

Nucleic acids encoding CER2-like polypeptides may be derived from any natural or artificial source. The nucleic acid may be modified from its native form in composition and/or genomic environment through deliberate human manipulation. Preferably the CER2-like polypeptide-encoding nucleic acid is from a plant, further preferably from a dicotyledonous plant, more preferably from the family Fabaceae, most preferably the nucleic acid is from *Medicago truncatula*.

Nucleic acids encoding At1g68440-like polypeptides may be derived from any natural or artificial source. The nucleic acid may be modified from its native form in composition and/or genomic environment through deliberate human manipulation. Preferably the At1g68440-like polypeptide-encoding nucleic acid is from a plant, further preferably from a dicotyledonous plant, more preferably from the family Salicaceae, most preferably the nucleic acid is from *Populus trichocarpa*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in early vigour and/or in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

The present invention provides a method for increasing yield-related traits, especially seed yield of plants, relative to control plants, which method comprises modulating expression in a plant of a nucleic acid encoding a DEAD-box RNA helicase polypeptide, or a CER2-like (CER2-like acyl transferase) polypeptide, or an At1g68440-like polypeptide as defined herein.

Since the transgenic plants according to the present invention have increased seed yield, it is likely that these plants exhibit an increased growth rate (during at least part of their life cycle), relative to the growth rate of control plants at a corresponding stage in their life cycle.

Concerning DEAD-box RNA helicase polypeptides, according to a preferred feature of the present invention, performance of the methods of the invention gives plants having an increased growth rate relative to control plants. Therefore, according to the present invention, there is provided a method for increasing the growth rate of plants, which method comprises reducing or substantially eliminating expression in a plant of a nucleic acid encoding a DEAD-box RNA helicase polypeptide as defined herein.

Concerning CER2-like polypeptides, and At1g68440-like polypeptides, according to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a CER2-like polypeptide as defined herein.

Concerning DEAD-box RNA helicase polypeptides, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises reducing or substantially eliminating expression in a plant of a nucleic acid encoding a DEAD-box RNA helicase polypeptide.

Concerning CER2-like polypeptides, and At1g68440-like polypeptides, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a CER2-like polypeptide.

Concerning DEAD-box RNA helicase polypeptides, performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises reducing or substantially eliminating expression in a plant of a nucleic acid encoding a DEAD-box RNA helicase polypeptide.

Concerning CER2-like polypeptides, and At1g68440-like polypeptides, performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a CER2-like polypeptide.

Concerning DEAD-box RNA helicase polypeptides, performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises reducing or substantially eliminating expression in a plant of a nucleic acid encoding a DEAD-box RNA helicase polypeptide.

Concerning CER2-like polypeptides, and At1g68440-like polypeptides, performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding a CER2-like polypeptide.

Concerning DEAD-box RNA helicase polypeptides, performance of the methods of the invention gives plants grown under conditions of drought stress, increased yield relative to control plants grown under comparable conditions. Therefore, according to the present invention, there is provided a method for increasing yield in plants grown under conditions of drought stress, which method comprises reducing or substantially eliminating expression in a plant of a nucleic acid encoding a DEAD-box RNA helicase polypeptide.

Concerning CER2-like polypeptides, and At1g68440-like polypeptides, performance of the methods of the invention gives plants grown under conditions of drought stress, increased yield relative to control plants grown under comparable conditions. Therefore, according to the present invention, there is provided a method for increasing yield in plants grown under conditions of drought stress, which method comprises modulating expression in a plant of a nucleic acid encoding a CER2-like polypeptide.

The invention also provides genetic constructs and vectors to facilitate introduction and/or expression in plants of nucleic acids encoding an inverted repeat of DEAD-box RNA helicase polypeptides, or CER2-like polypeptides, or At1g68440-like polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

Concerning DEAD-box RNA helicase polypeptides, more specifically, the present invention provides a construct comprising:
  (a) an inverted repeat of a DEAD-box RNA helicase gene or fragment, capable of downregulating an endogeneous target DEAD-box RNA helicase;
  (b) one or more control sequences capable of driving expression of the nucleic acid sequence of (a); and optionally
  (c) a transcription termination sequence.

Preferably, the nucleic acid encoding a DEAD-box RNA helicase polypeptide is as defined above. The term "control sequence" and "termination sequence" are as defined herein.

Concerning CER2-like polypeptides, more specifically, the present invention provides a construct comprising:
  (a) a nucleic acid encoding a CER2-like polypeptide as defined above;
  (b) one or more control sequences capable of driving expression of the nucleic acid sequence of (a); and optionally
  (c) a transcription termination sequence.

Preferably, the nucleic acid encoding a CER2-like polypeptide is as defined above. The term "control sequence" and "termination sequence" are as defined herein.

Concerning At1g68440-like polypeptides, more specifically, the present invention provides a construct comprising:
(a) a nucleic acid encoding an At1g68440-like polypeptide as defined above;
(b) one or more control sequences capable of driving expression of the nucleic acid sequence of (a); and optionally
(c) a transcription termination sequence.

Preferably, the nucleic acid encoding an At1g68440-like polypeptide is as defined above. The term "control sequence" and "termination sequence" are as defined herein.

The invention furthermore provides plants transformed with a construct as described above. In particular, the invention provides plants transformed with a construct as described above, which plants have increased yield-related traits as described herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is a ubiquitous constitutive promoter of medium strength. See the "Definitions" section herein for definitions of the various promoter types.

Concerning DEAD-box RNA helicase genes, it should be clear that the applicability of the present invention is not restricted to the DEAD-box RNA helicase polypeptide-encoding nucleic acid represented by SEQ ID NO: 1, nor is the applicability of the invention restricted to expression of a DEAD-box RNA helicase polypeptide-encoding nucleic acid when driven by a constitutive promoter.

The constitutive promoter is preferably a medium strength promoter. More preferably it is a plant derived promoter, such as a GOS2 promoter or a promoter of substantially the same strength and having substantially the same expression pattern (a functionally equivalent promoter), more preferably the promoter is the promoter GOS2 promoter from rice. Further preferably the constitutive promoter is represented by a nucleic acid sequence substantially similar to SEQ ID NO: 156, most preferably the constitutive promoter is identical to SEQ ID NO: 156. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 156, and the nucleic acid encoding the DEAD-box RNA helicase polypeptide. Furthermore, one or more sequences encoding selectable markers may be present on the construct introduced into a plant.

Concerning CER2-like genes, it should be clear that the applicability of the present invention is not restricted to the CER2-like polypeptide-encoding nucleic acid represented by SEQ ID NO: 168, nor is the applicability of the invention restricted to expression of a CER2-like polypeptide-encoding nucleic acid when driven by a constitutive promoter, or when driven by a root-specific promoter.

The constitutive promoter is preferably a medium strength promoter. More preferably it is a plant derived promoter, such as a GOS2 promoter or a promoter of substantially the same strength and having substantially the same expression pattern (a functionally equivalent promoter), more preferably the promoter is the promoter GOS2 promoter from rice. Further preferably the constitutive promoter is represented by a nucleic acid sequence substantially similar to SEQ ID NO: 289, most preferably the constitutive promoter is as represented by SEQ ID NO: 289. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 289, and the nucleic acid encoding the CER2-like polypeptide. More preferably, the expression cassette comprises the sequence represented by SEQ ID NO: 290 (pPRO::CER2-like gene::t-zein sequence). Furthermore, one or more sequences encoding selectable markers may be present on the construct introduced into a plant.

Concerning At1g68440-like genes, it should be clear that the applicability of the present invention is not restricted to the At1g68440-like polypeptide-encoding nucleic acid represented by SEQ ID NO: 291, nor is the applicability of the invention restricted to expression of an At1g68440-like polypeptide-encoding nucleic acid when driven by a constitutive promoter.

The constitutive promoter is preferably a medium strength promoter. More preferably it is a plant derived promoter, such as a GOS2 promoter or a promoter of substantially the same strength and having substantially the same expression pattern (a functionally equivalent promoter), more preferably the promoter is the promoter GOS2 promoter from rice. Further preferably the constitutive promoter is represented by a nucleic acid sequence substantially similar to SEQ ID NO: 363, most preferably the constitutive promoter is as represented by SEQ ID NO: 363. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 363, and the nucleic acid encoding the At1g68440-like polypeptide.

Concerning DEAD-box RNA helicase genes, according to a preferred feature of the invention, the modulated expression is reduced or substantially eliminated expression. Methods for reducing or eliminating expression of nucleic acids or genes, or gene products, are well documented in the art and examples are provided in the definitions section.

Concerning CER2-like polypeptides, and At1g68440-like polypeptides, according to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a DEAD-box RNA helicase polypeptide, or a CER2-like (CER2-like acyl transferase) polypeptide, or an At1g68440-like polypeptide is by introducing and expressing in a plant a nucleic acid encoding a DEAD-box RNA helicase polypeptide, or a CER2-like (CER2-like acyl transferase) polypeptide, or an At1g68440-like polypeptide; however the effects of performing the method, i.e. enhancing yield-related traits may also be achieved using other well known techniques, including but not limited to T-DNA inactivation, TILLING, homologous recombination. A description of these techniques is provided in the definitions section.

Concerning DEAD-box RNA helicase polypeptides, the invention also provides a method for the production of transgenic plants having enhanced yield-related traits relative to control plants, comprising reducing or substantially eliminating expression in a plant of any nucleic acid encoding a DEAD-box RNA helicase polypeptide as defined hereinabove.

More specifically, the present invention provides a method for the production of transgenic plants having enhanced yield-related traits, particularly increased seed yield, which method comprises:
  (i) reducing or substantially eliminating expression in a plant or plant cell a DEAD-box RNA helicase polypeptide-encoding nucleic acid; and
  (ii) cultivating the plant cell under conditions promoting plant growth and development.

The nucleic acid of (i) may be any of the nucleic acids capable of encoding a DEAD-box RNA helicase polypeptide as defined herein.

Concerning CER2-like polypeptides, and At1g68440-like polypeptides, the invention also provides a method for the production of transgenic plants having enhanced yield-related traits relative to control plants, comprising introduction and expression in a plant of any nucleic acid encoding a CER2-like polypeptide, or an At1g68440-like polypeptide as defined hereinabove.

More specifically, the present invention provides a method for the production of transgenic plants having enhanced yield-related traits, particularly increased seed yield, which method comprises:
  (i) introducing and expressing in a plant or plant cell a CER2-like nucleic acid encoding a CER2-like polypeptide, or an At1g68440-like polypeptide or a genetic construct comprising a CER2-like polypeptide-encoding nucleic acid; and
  (ii) cultivating the plant cell under conditions promoting plant growth and development.

The nucleic acid of (i) may be any of the nucleic acids capable of encoding a CER2-like polypeptide, or an At1g68440-like polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The present invention clearly extends to any plant cell or plant produced by any of the methods described herein, and to all plant parts and propagules thereof. The present invention encompasses plants or parts thereof, including seeds, obtainable by the methods according to the present invention. The plants or parts thereof comprise a nucleic acid transgene encoding a DEAD-box RNA helicase polypeptide as defined above. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a DEAD-box RNA helicase polypeptide, or a CER2-like polypeptide, or an At1g68440-like polypeptide as defined hereinabove. Preferred host cells according to the invention are plant cells, bacterial, yeast or fungal cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant, in particular to any plant as defined herein. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include but are not limited to chicory, carrot, cassava, trefoil, soybean, beet, sugar beet, sunflower, canola, alfalfa, rapeseed, linseed, cotton, tomato, potato and tobacco. According to another embodiment of the present invention, the plant is a monocotyledonous plant. Examples of monocotyledonous plants include sugarcane. According to another embodiment of the present invention, the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding a DEAD-box RNA helicase polypeptide, or a CER2-like polypeptide, or an At1g68440-like polypeptide. The invention furthermore relates to products derived, preferably directly derived, from a harvestable part of such a plant, such as dry pellets or powders, oil, fat and fatty acids, starch or proteins.

The present invention also encompasses use of nucleic acids encoding DEAD-box RNA helicase polypeptides as described herein and use of these DEAD-box RNA helicase polypeptides in enhancing any of the aforementioned yield-related traits in plants. For example, nucleic acids encoding DEAD-box RNA helicase polypeptide, or CER2-like polypeptide, or At1g68440-like polypeptide described herein, or the DEAD-box RNA helicase polypeptides, or the CER2-like polypeptides, or the At1g68440-like polypeptides themselves, may find use in breeding programmes in which a DNA marker is identified which may be genetically linked to polypeptide gene encoding a DEAD-box RNA helicase polypeptide, or a CER2-like polypeptide, or an At1g68440-like polypeptide. The nucleic acids/genes, or the DEAD-box RNA helicase polypeptides, or the CER2-like polypeptides, or the At1g68440-like polypeptides themselves may be used to define a molecular marker. This DNA or protein marker may then be used in breeding programmes to select plants having enhanced yield-related traits as defined hereinabove in the methods of the invention. Furthermore, allelic variants of nucleic acid/gene encoding a DEAD-box RNA helicase polypeptide, or a CER2-like polypeptide, or an At1g68440-like polypeptide may find use in marker-assisted breeding programmes. Nucleic acids encoding DEAD-box RNA helicase polypeptides, or CER2-like polypeptides, or At1g68440-like polypeptides may also be used as probes for genetically and physically mapping the genes that they are a part of, and as markers for traits linked to those genes. Such information may be useful in plant breeding in order to develop lines with desired phenotypes.

Items

1. A method for enhancing yield-related traits in plants relative to control plants, comprising modulating expression in a plant of a nucleic acid encoding a CER2-like polypeptide, wherein said CER2-like polypeptide comprises a PF02458 domain and/or possesses transferase activity.
2. Method according to item 1, wherein said modulated expression is effected by introducing and expressing in a plant said nucleic acid encoding said CER2-like polypeptide.
3. Method according to item 1 or 2, wherein said enhanced yield-related traits comprise increased yield and/or early vigour relative to control plants, and preferably comprise increased biomass and/or increased seed yield relative to control plants.
4. Method according to any one of items 1 to 3, wherein said enhanced yield-related traits are obtained under non-stress conditions.
5. Method according to any one of items 1 to 3, wherein said enhanced yield-related traits are obtained under conditions of drought stress, salt stress or nitrogen deficiency.
6. Method according to any of items 1 to 5, wherein said CER2-like polypeptide comprises one or more of the following motifs:

Motif 18a:
(SEQ ID NO: 274)
FKCGGL[SA][LI]G[LV][SG]W[AS]HI[LV][GA]D[GA]FSA
SHFIN[SA]W, Motif 19a:
(SEQ ID NO: 276)
SGR[PL]E[IVL]KCNDEG[VA][RL][FI][VI]EAE[CA]D, Motif 20a:
(SEQ ID NO: 278)
xY[ST][TR][FY]E[AI]L[AST][AG][HL][IV]W[RK][CS]I
[AC]KARG 7. Method according any of items 1 to 5, wherein said CER2-like polypeptide comprises Motif 21a:
(SEQ ID NO: 280)
VQ[VF]TxFKCGG[LM][SA][LIV]GLS[WC]AH[IVL]LGD[APV]
FSA[ST]TF[FIM][NK]KW Motif 22a:
(SEQ ID NO: 282)
[EA]SGR[PW][YF][IV]KCND[AC]GVRIVEA[KHR]CDK Motif 23a:
(SEQ ID NO: 284)
SR[VT][GE][EP][GN]Kx[HY]E[LP][ST]x[LM]DLAMKLHY
[LVI]R[GA]VY[FY][FY]

8. Method according any of items 1 to 5, wherein said CER2-like polypeptide comprises Motif 24:
(SEQ ID NO: 286)
FKCGG[VIF][SA][LI]G[VL]G[MI]SHx[VLM]ADGxSALHFI
[NS][SAT]W Motif 25:
(SEQ ID NO: 287)
NPNLL[IV][TV]SWT[RT][LF]P[ILF][YH][DE]ADFGWG[KR]
PI[FY]MGP Motif 26:
(SEQ ID NO: 288)
[SA]LS[KE][VT]L[VT][HP][FY]YP[ML]AGR.

9. Method according to any one of items 1 to 8, wherein said nucleic acid encoding a CER2-like is of plant origin, preferably from a dicotyledonous plant, further preferably from the family Fabaceae, more preferably from the genus *Medicago*, most preferably from *Medicago truncatula*.
10. Method according to any one of items 1 to 9, wherein said nucleic acid encoding a CER2-like encodes any one of the polypeptides listed in Table A2 or is a portion of such a nucleic acid, or a nucleic acid capable of hybridising with such a nucleic acid.
11. Method according to any one of items 1 to 10, wherein said nucleic acid sequence encodes an orthologue or paralogue of any of the polypeptides given in Table A2.
12. Method according to any one of items 1 to 11, wherein said nucleic acid encoding said CER2-like polypeptide corresponds to SEQ ID NO: 291.
13. Method according to any one of items 1 to 12, wherein said nucleic acid is operably linked to a constitutive promoter, preferably to a medium strength constitutive promoter, preferably to a plant promoter, more preferably to a GOS2 promoter, most preferably to a GOS2 promoter from rice.
14. Plant, plant part thereof, including seeds, or plant cell, obtainable by a method according to any one of items 1 to 13, wherein said plant, plant part or plant cell comprises a recombinant nucleic acid encoding a CER2-like polypeptide as defined in any of items 1 and 5 to 12.
15. Construct comprising:
    (i) nucleic acid encoding a CER2-like as defined in any of items 1 and 6 to 12;
    (ii) one or more control sequences capable of driving expression of the nucleic acid sequence of (i); and optionally
    (iii) a transcription termination sequence.
16. Construct according to item 15, wherein one of said control sequences is a constitutive promoter, preferably a medium strength constitutive promoter, preferably to a plant promoter, more preferably a GOS2 promoter, most preferably a GOS2 promoter from rice.
17. Use of a construct according to item 15 or 16 in a method for making plants having enhanced yield-related traits, preferably increased yield relative to control plants, and more preferably increased seed yield and/or increased biomass relative to control plants.
18. Plant, plant part or plant cell transformed with a construct according to item 15 or 16.
19. Method for the production of a transgenic plant having enhanced yield-related traits relative to control plants, preferably increased yield relative to control plants, and more preferably increased seed yield and/or increased biomass relative to control plants, comprising:
    (i) introducing and expressing in a plant cell or plant a nucleic acid encoding a CER2-like polypeptide as defined in any of items 1 and 5 to 12; and
    (ii) cultivating said plant cell or plant under conditions promoting plant growth and development.
20. Transgenic plant having enhanced yield-related traits relative to control plants, preferably increased yield relative to control plants, and more preferably increased seed yield and/or increased biomass, resulting from modulated expression of a nucleic acid encoding a CER2-like polypeptide as defined in any of items 1 and 6 to 12 or a transgenic plant cell derived from said transgenic plant.
21. Transgenic plant according to item 14, 18 or 20, or a transgenic plant cell derived therefrom, wherein said plant is a crop plant, such as beet, sugarbeet or alfalfa; or a monocotyledonous plant such as sugarcane; or a cereal, such as rice, maize, wheat, barley, millet, rye, triticale, sorghum, emmer, spelt, secale, einkorn, teff, milo or oats.
22. Harvestable parts of a plant according to item 21, wherein said harvestable parts are preferably shoot biomass and/or seeds.
23. Products derived from a plant according to item 21 and/or from harvestable parts of a plant according to item 22.
24. Use of a nucleic acid encoding a CER2-like polypeptide as defined in any of items 1 and 6 to 12 for enhancing yield-related traits in plants relative to control plants, preferably for increasing yield, and more preferably for increasing seed yield and/or for increasing biomass in plants relative to control plants.
25. A method for enhancing yield-related traits in plants relative to control plants, comprising modulating expression in a plant of a nucleic acid encoding an At1g68440-like polypeptide, wherein said At1g68440-like polypeptide comprises a transmembrane domain.
26. Method according to item 25, wherein said modulated expression is effected by introducing and expressing in a plant said nucleic acid encoding said At1g68440-like polypeptide.
27. Method according to item 25 or 26, wherein said enhanced yield-related traits comprise increased yield relative to control plants, and preferably comprise increased biomass and/or increased seed yield relative to control plants.
28. Method according to any one of items 25 to 27, wherein said enhanced yield-related traits are obtained under non-stress conditions.
29. Method according to any one of items 25 to 27, wherein said enhanced yield-related traits are obtained under conditions of drought stress, salt stress or nitrogen deficiency.
30. Method according to any of items 25 to 29, wherein said At1g68440-like polypeptide comprises one or more of the following motifs:

```
Motif 26a:
                                 (SEQ ID NO: 364)
Y[SN]F[WC][KT]WGALILA[LV][FVL]A, Motif 27a:
                                 (SEQ ID NO: 366)
ME[IV][PT][VE][IL]N[RL]I[SG]DF, Motif 28a:
                                 (SEQ ID NO: 368)
[SN]VV[KQ]LWD[SN]LG[LF]
```

31. Method according to any one of items 25 to 30, wherein said nucleic acid encoding an At1g68440-like is of plant origin, preferably from a dicotyledonous plant, further preferably from the family Salicaceae, more preferably from the genus *Populus*, most preferably from *Populus trichocarpa*.
32. Method according to any one of items 25 to 30, wherein said nucleic acid encoding an At1g68440-like encodes any one of the polypeptides listed in Table A3 or is a portion of such a nucleic acid, or a nucleic acid capable of hybridising with such a nucleic acid.
33. Method according to any one of items 25 to 32, wherein said nucleic acid sequence encodes an orthologue or paralogue of any of the polypeptides given in Table A3.
34. Method according to any one of items 25 to 33, wherein said nucleic acid encoding said At1g68440-like polypeptide corresponds to SEQ ID NO: 291.
35. Method according to any one of items 25 to 34, wherein said nucleic acid is operably linked to a constitutive promoter, preferably to a medium strength constitutive promoter, preferably to a plant promoter, more preferably to a GOS2 promoter, most preferably to a GOS2 promoter from rice.
36. Plant, plant part thereof, including seeds, or plant cell, obtainable by a method according to any one of items 25 to 34, wherein said plant, plant part or plant cell comprises a recombinant nucleic acid encoding an At1g68440-like polypeptide as defined in any of items 25 and 30 to 34.
37. An isolated nucleic acid molecule selected from:
a nucleic acid represented by SEQ ID NO: 291;
the complement of a nucleic acid represented by SEQ ID NO: 291;
a nucleic acid encoding an At1g68440-like polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 292, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 364 to SEQ ID NO: 375, and further preferably conferring enhanced yield-related traits relative to control plants.
a nucleic acid molecule which hybridizes with a nucleic acid molecule of (i) to (iii) under high stringency hybridization conditions and preferably confers enhanced yield-related traits relative to control plants.
a nucleic acid encoding an At1g68440-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 292 and any of the other amino acid sequences in Table A3 and preferably conferring enhanced yield-related traits relative to control plants.
38. An isolated polypeptide selected from:
an amino acid sequence represented by SEQ ID NO: 292;
an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 2, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 364 to SEQ ID NO: 375, and/or any of the other amino acid sequences in Table A3, and further preferably conferring enhanced yield-related traits relative to control plants;
derivatives of any of the amino acid sequences given in (i) or (ii) above.

39. Construct comprising:
nucleic acid encoding an At1g68440-like as defined in any of items 25 and 30 to 34;
one or more control sequences capable of driving expression of the nucleic acid sequence of (i); and optionally a transcription termination sequence.

40. Construct according to item 39, wherein one of said control sequences is a constitutive promoter, preferably a medium strength constitutive promoter, preferably to a plant promoter, more preferably a GOS2 promoter, most preferably a GOS2 promoter from rice.

41. Use of a construct according to item 39 or 40 in a method for making plants having enhanced yield-related traits, preferably increased yield relative to control plants, and more preferably increased seed yield and/or increased biomass relative to control plants.

42. Plant, plant part or plant cell transformed with a construct according to item 39 or 40.

43. Method for the production of a transgenic plant having enhanced yield-related traits relative to control plants, preferably increased yield relative to control plants, and more preferably increased seed yield and/or increased biomass relative to control plants, comprising:
introducing and expressing in a plant cell or plant a nucleic acid encoding an At1g68440-like polypeptide as defined in any of items 25 and 30 to 34; and
cultivating said plant cell or plant under conditions promoting plant growth and development.

44. Transgenic plant having enhanced yield-related traits relative to control plants, preferably increased yield relative to control plants, and more preferably increased seed yield and/or increased biomass, resulting from modulated expression of a nucleic acid encoding an At1g68440-like polypeptide as defined in any of items 25 and 30 to 34 or a transgenic plant cell derived from said transgenic plant.

45. Transgenic plant according to item 36, 42 or 44, or a transgenic plant cell derived therefrom, wherein said plant is a crop plant, such as beet, sugarbeet or alfalfa; or a monocotyledonous plant such as sugarcane; or a cereal, such as rice, maize, wheat, barley, millet, rye, triticale, sorghum, emmer, spelt, secale, einkorn, teff, milo or oats.

46. Harvestable parts of a plant according to item 45, wherein said harvestable parts are preferably shoot biomass and/or seeds.

47. Products derived from a plant according to item 45 and/or from harvestable parts of a plant according to item 46.

48. Use of a nucleic acid encoding an At1g68440-like polypeptide as defined in any of items 25 and 30 to 34 for enhancing yield-related traits in plants relative to control plants, preferably for increasing yield, and more preferably for increasing seed yield and/or for increasing biomass in plants relative to control plants.

49. A method for enhancing yield-related traits in plants relative to control plants, comprising reducing or substantially eliminating expression in a plant of a nucleic acid encoding a DEAD-box RNA helicase polypeptide and/or the level and/or the activity of a DEAD-box RNA helicase polypeptide in said plant, wherein said DEAD-box RNA helicase polypeptide comprises signature pattern [LIVMF]-[LIVMFFD-E-A-D4RKEN]-X-[LIVMFYG-STN] (SEQ ID NO: 159).

50. Method according to item 49, wherein said DEAD-box RNA helicase polypeptide is an orthologue or paralogue to subfamily VI of the 6 subfamilies of DEAD-box RNA helicases as described by Aubourg et al. (1999).

51. Method according to item 49 or 50, wherein said DEAD-box RNA helicase polypeptide comprises one or more of the following motifs:

(i) Motif 1:
(SEQ ID NO: 3)
[LM][VI]ATDVA[AS]RGLD[IV][KP]D[VI][EK]VV[IV]
N[YF][SD][YF]P[LN][TD][IT][ED]DYVHRIGRTGRA, (ii) Motif 2:
(SEQ ID NO: 4)
[RSN]L[NR][DR]V[TS][YF][LV]VLDEADRMLDMGFEP
[EQ][IV]R[AK]I[VL], (iii) Motif 3:
(SEQ ID NO: 5)
P[TS]PIQA[YQ][AS][WI]P[YI][AL][LM][DS]GRD
[FL][IV][GA]IA[KA]TGSGKT 52. Method according to any of the items 49 to 51, wherein said nucleic acid encoding a DEAD-box RNA helicase polypeptide encodes any one of the proteins listed in Table A1 or is a portion of such a nucleic acid, or a nucleic acid capable of hybridising with such a nucleic acid.

53. Method according to any one of items 49 to 52, wherein said nucleic acid sequence encodes an orthologue or paralogue of any of the proteins given in Table A1.

54. Method according to any of the items 49 to 53, wherein said reduction or substantial elimination is effected by RNA-mediated downregulation of gene expression.

55. Method according to item 54, wherein said RNA-mediated downregulation is effected by co-suppression.

56. Method according to item 55, wherein said RNA-mediated downregulation is effected by use of antisense DEAD-box RNA helicase nucleic acid sequences.

57. Method according to any of the items 49 to 53, wherein said reduction or substantial elimination is effected by using an inverted repeat of a DEAD-box RNA helicase nucleic acid sequences or fragment thereof.

58. Method according to any of the items 49 to 53, wherein said reduction or substantial elimination is effected using a microRNA.

59. Method according to any of the items 49 to 53, wherein said reduction or substantial elimination is effected by insertion mutagenesis.

60. Method according to any of the items 49 to 59, comprising introduction into a host plant a DEAD-box RNA helicase nucleic acid or a fragment thereof substantially homologous to said nucleic acid encoding a DEAD-box RNA helicase polypeptide.

61. Method according to any of the items 49 to 59, wherein said reduction or substantial elimination is effected in a constitutive manner preferably by using a constitutive promoter, more preferably a GOS2 promoter, most preferably to a GOS2 promoter from rice.

62. Method according to item 60 or 61, wherein said introduced nucleic acid is from the same family, more preferably from the same genus, even more preferably from same species as the host plant.

63. Method according to any of the items 60 to 62, wherein said introduced DEAD-box RNA helicase nucleic acid sequence comprises a sufficient length of substantially contiguous nucleotides of SEQ ID NO: 1 or an orthologue or paralogue thereof and wherein said host plant is a cereal, preferably rice.

64. Method according to item 63, wherein said nucleic acid encodes a protein as represented by any one of the SEQ ID NO: 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155.

65. Method according to item 63 or 64, wherein said nucleic acid is a represented by any of SEQ ID NO: 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154.

66. Method according to any of items 49 to 65, wherein said enhanced yield-related traits is increased seed yield relative to control plants.

67. Method according to item 66, wherein said increased seed yield is selected from one or more of the following: a) increased seed biomass, i.e. seed weight; b) increased number of filled seeds; c) increased fill rate and d) increased harvest index.

68. Method according to any of the items 49 to 67, wherein said increased yield is obtained under non-stress conditions.

69. Method according to any or the items 49 to 67, wherein said increased yield is obtained under conditions of drought stress, salt stress or nitrogen deficiency.

70. Plant or part thereof, including seeds, obtainable by a method according to any one of the items 49 to 69, wherein said plant or part thereof comprises a recombinant nucleic acid encoding a DEAD-box RNA helicase polypeptide.

71. Construct comprising:
   (a) an inverted repeat of a DEAD-box RNA helicase gene or fragment, capable of downregulating an endogeneous target DEAD-box RNA helicase;
   (b) one or more control sequences capable of driving expression of the nucleic acid sequence of (a); and optionally
   (c) transcription termination sequence.

72. Construct according to item 71, wherein one of said control sequences is a constitutive promoter, preferably a GOS2 promoter, most preferably a GOS2 promoter from rice.

73. Use of a construct according to item 71 or 72 in a method for making plants having increased yield, particularly increased biomass and/or increased seed yield relative to control plants.

74. Plant, plant part or plant cell transformed with a construct according to item 71 or 72.

75. Method for the production of a transgenic plant having increased yield, particularly increased seed yield relative to control plants, comprising:
   (i) introducing and expressing in a plant cell the construct according to item 71 or 72; and
   (ii) cultivating the plant cell under conditions promoting plant growth and development.

76. Use of DEAD-box RNA helicase nucleic acids for the reduction or substantial elimination of endogenous DEAD-box gene expression in plant to increase yield in plants relative to control plants.

77. Use according to item 76, wherein said increased yield is increased seed yield.

78. Use according to item 77, wherein said increased seed yield is selected from one or more of the following: a) increased seed biomass, i.e. seed weight; b) increased number of filled seeds; c) increased fill rate and d) increased harvest index.

79. Use according to any one of items 76 to 78, wherein said yield increase occurs under stress conditions.

80. An isolated nucleic acid molecule selected from:
   (a) a nucleic acid represented by SEQ ID NO: 12 or 14;
   (b) the complement of a nucleic acid represented by SEQ ID NO: 12 or 14;
   (c) a nucleic acid encoding a DEAD-box RNA helicase polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 13 or 15, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 3 to SEQ ID NO: 11, and further preferably conferring enhanced yield-related traits relative to control plants.
   (d) a nucleic acid molecule which hybridizes with a nucleic acid molecule of (i) to (iii) under high stringency hybridization conditions and preferably confers enhanced yield-related traits relative to control plants.

81. An isolated polypeptide selected from:
   (i) an amino acid sequence represented by SEQ ID NO: 13 or 15;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 13 or 15, and additionally or alternatively comprising one or more motifs having in increasing order of preference at least 50%, 55%, 60%, 65%, 70%, 75%, 80%, 85%, 90%, 95%, 96%, 97%, 98%, 99% or more sequence identity to any one or more of the motifs given in SEQ ID NO: 3 to SEQ ID NO: 11, and further preferably conferring enhanced yield-related traits relative to control plants;
   (iii) derivatives of any of the amino acid sequences given in (i) or (ii) above.

82. Transgenic plant having increased yield, particularly increased biomass and/or increased seed yield, relative to control plants, resulting from reduced or substantially eliminated expression of a nucleic acid encoding a DEAD-box RNA helicase polypeptide as defined in item 49 or 50, or a transgenic plant cell derived from said transgenic plant.

83. Transgenic plant according to item 70 or 74, or a transgenic plant cell derived thereof, wherein said plant is a crop plant, such as beet, sugarbeet or alfalfa, or a monocot such as sugarcane, or a cereal, such as rice, maize, wheat, barley, millet, rye, triticale, sorghum emmer, spelt, secale, einkorn, teff, milo and oats.

84. Harvestable parts of a plant according to item 82 and 83, wherein said harvestable parts are preferably shoot biomass and/or seeds.

85. Products derived from a plant according to item 82 and 83 and/or from harvestable parts of a plant according to item 84.

DESCRIPTION OF FIGURES

The present invention will now be described with reference to the following figures in which:

FIG. 1 represents the domain structure of SEQ ID NO: 2 with conserved MEME motifs FIG. 2 represents a multiple alignment of various DEAD-box RNA helicase polypeptides of clade A as shown in FIG. 3. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. Aquilegia_sp_TC27171#1_A: SEQ ID NO: 19; V.vinifera GSVIVT00003606001#1: SEQ ID NO: 43; G.max_Glyma01g01390.1#1_A: SEQ ID NO: 23; G.max_GM06MC17187_59654952@168: SEQ ID NO: 13; M.truncatula_CU459038_20.4#1_A: SEQ ID NO: 29; G.raimondii_TC4727#1_A: SEQ ID NO: 25; S.bicolor_Sb02g009590.1#1_A SEQ ID NO: 39; Z.mays_ZMO7MC20090_BFb0116P06@: SEQ ID NO: 15; O.sativa_LOC_Os07g20580.1#1_A: SEQ ID NO: 2; H.vulgare_TC183460#1_A: SEQ ID NO: 27; A.thaliana_AT1G31970.1#1_A: SEQ ID NO: 17; P.patens_205380#1_A: SEQ ID NO: 37; Chlorella_36420#1_A: SEQ ID NO: 21; V.carteri_103394#1_A: SEQ ID NO: 41; O.lucimarinus_38084#1_A: SEQ ID NO: 31; O.RCC809_33138#1_A: SEQ ID NO: 33; and O.taurii_19637#1_A: SEQ ID NO: 35.

FIG. 4 shows the MATGAT table for clade A as shown in FIG. 3.

FIG. 7 represents the domain structure of SEQ ID NO: 169 with conserved motifs or domains.

FIG. 8 represents a multiple alignment of various CER2-like polypeptides. These alignments can be used for defining further motifs, when using conserved amino acids. M.truncatula_CU137640_9.3#1A: SEQ ID NO: 171; M.truncatula_transferase_CER2-like#1_A: SEQ ID NO: 169; P.trichocarpa_757078#1_A: SEQ ID NO: 209; G.max_GMO6MC00033_47170619@33#1_A: SEQ ID NO: 173; G.max_Glyma02g37870.1#1_A: SEQ ID NO: 175; P.trichocarpa_558994#1_A: SEQ ID NO: 177; Aquilegia_sp_TC23512#1_A: SEQ ID NO: 179; G.max_Glyma08g11560.1#1_A: SEQ ID NO: 189; P.trichocarpa_549793#1_A: SEQ ID NO: 191; O.basilicum_TA1387_39350#1_A: SEQ ID NO: 193; B.napus_BN06MC34354 BNP3363_30@34198#1_A: SEQ ID NO: 181; A.thaliana_AT4G24510.1#1_A: SEQ ID NO: 183; A.thaliana_AT3G23840.1#1_A: SEQ ID NO: 185'  A.thaliana_AT4G13840.1#1_A: SEQ ID NO: 187' O.sativa_LOC_Os04_52164.1#1_A: SEQ ID NO: 195; T.aestivum_TC294447#1_A: SEQ ID NO: 197; A.thaliana_AT4G29250.1#1_A: SEQ ID NO: 199; G.max_Glyma17g31040.1#1_A: SEQ ID NO: 201; P.taeda_TA11048_3352#1_A: SEQ ID NO: 203; G.max_Glyma03g40670.1#1_A: SEQ ID NO: 205; Z.mays_ZM07MC26485_BFb0067H12@26407#1_A: SEQ ID NO: 207; A.thaliana_AT1G27620.1#1_B: SEQ ID NO: 213; A.thaliana_AT2G19070.1#1_B: SEQ ID NO: 215; P.trichocarpa_810871#1_B: SEQ ID NO: 257; G.max_Glyma17g06860.1#1_B: SEQ ID NO: 237; V.vinifera_GSVIVT00017176001#1_B: SEQ ID NO: 265; Aquilegia_sp_TC20397#1_B; SEQ ID NO: 223; G.max_Glyma08_42490.1#1_B: SEQ ID NO: 233; G.max_GM06MC27564 sae62b11@26939#1_B: SEQ ID NO: 239; A.thaliana_AT5G48930.1#1_B: SEQ ID NO: 219; P.trichocarpa_587193#1_B: SEQ ID NO: 249; G.max_Glyma13g44830.1#1_B: SEQ ID NO: 235; P.vulgaris_TC13456#1_B: SEQ ID NO: 261; L.sativa_TC19194#1_B: SEQ ID NO: 241; S.lycopersicum_TC201861#1_B: SEQ ID NO: 263; P.trichocarpa_784746#1_B: SEQ ID NO: 253; G.hirsutum_TC130878#1_B: SEQ ID NO: 229; M.esculenta_TA8094_3983#1_B: SEQ ID NO: 243; M.truncatula_AC148816_16.4#1_B: SEQ ID NO: 245; A.thaliana_AT5G41040.1#1_B: SEQ ID NO: 217; A.thaliana_AT5G63560.1#1_B: SEQ ID NO: 221; B.napus_BN06MC25915_51267477@25820#1_B: SEQ ID NO: 225; G.max_Glyma05g38290.1#1_B: SEQ ID NO: 231; P.trichocarpa_807676#1_B: SEQ ID NO: 255; P.patens_TC44371#1_B: SEQ ID NO: 271; S.moellendorffii_431283#1_B: SEQ ID NO: 269; B.napus_TC72743#1_B: SEQ ID NO: 227; P.trichocarpa_768990#1_B: SEQ ID NO: 251; V.vinifera_GSVIVT00035108001#1_B: SEQ ID NO: 267; P.trifoliata_TA5574_37690#1_B: SEQ ID NO: 259; and P.trichocarpa_579978#1_B: SEQ ID NO: 247.

FIG. 10 shows the MATGAT table (Example 3)

FIG. 12 represents the domain structure of SEQ ID NO: 292 with conserved motifs or domains.

FIG. 13 represents a multiple alignment of various At1g68440-like polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. A.lyrata_475964#1: SEQ ID NO: 312; A.thaliana_AT1G68440.1#1: SEQ ID NO: 318; A.lyrata_921679#1: SEQ ID NO: 314; A.thaliana_AT1G25400.1#1: SEQ ID NO: 316; C.clementina_DY272345#1: SEQ ID NO: 294; C.clementina_TC10465#1: SEQ ID NO: 296; C.clementina_TC31598#1: SEQ ID NO: 300; C.clementina_TC18948#1: SEQ ID NO: 298; P.trifoliata_TA5851_37690#1: SEQ ID NO: 308; P.trichocarpa_769638#1: SEQ ID NO: 304; P.trichocarpa_832731#1: SEQ ID NO: 306 Pt_putative_MP_dehydrogenase: SEQ ID NO: 292; R.communis_TA1965_3988#1: SEQ ID NO: 310; G.hirsutum_TC134197#1: SEQ ID NO: 302; M.domestica_TC34673#1: SEQ ID NO: 344; G.max_Glyma10g41960.1#1: SEQ ID NO: 324; G.max_TC278929#1: SEQ ID NO: 326; G.max_TC339602#1: SEQ ID NO: 328; P.vulgaris_TC13663#1: SEQ ID NO: 352; L.japonicus_TC42314#1: SEQ ID NO: 334; M.truncatula_AC135604_14.4#1: SEQ ID NO: 346; V.vinifera_GSVIVT00030351001#1: SEQ ID NO: 360; H.paradoxus_TA2948_73304#1: SEQ ID NO: 330; H.petiolaris_DY945986#1: SEQ ID NO: 332; L.saligna_DW067807#1: SEQ ID NO: 336; L.serriola_TC6013#1: SEQ ID NO: 340; L.virosa_DW158350#1: SEQ ID NO: 342; L.sativa_TC23070#1: SEQ ID NO: 338; T.officinale_TA2631_50225#1: SEQ ID NO: 356; N.tabacum_TC41632#1: SEQ ID NO: 348; S.lycopersicum_TC193481#1: SEQ ID NO: 354; O.basilicum_TA1347_39350#1: SEQ ID NO: 350; T.versicolor_TC2688#1: SEQ ID NO: 358; Aquilegia_sp_TC24194#1; SEQ ID NO: 320; and Aquilegia_sp_TC25879#1; SEQ ID NO: 322;

FIG. 15 shows the MATGAT table (Example 3)

EXAMPLES

Figure 3:
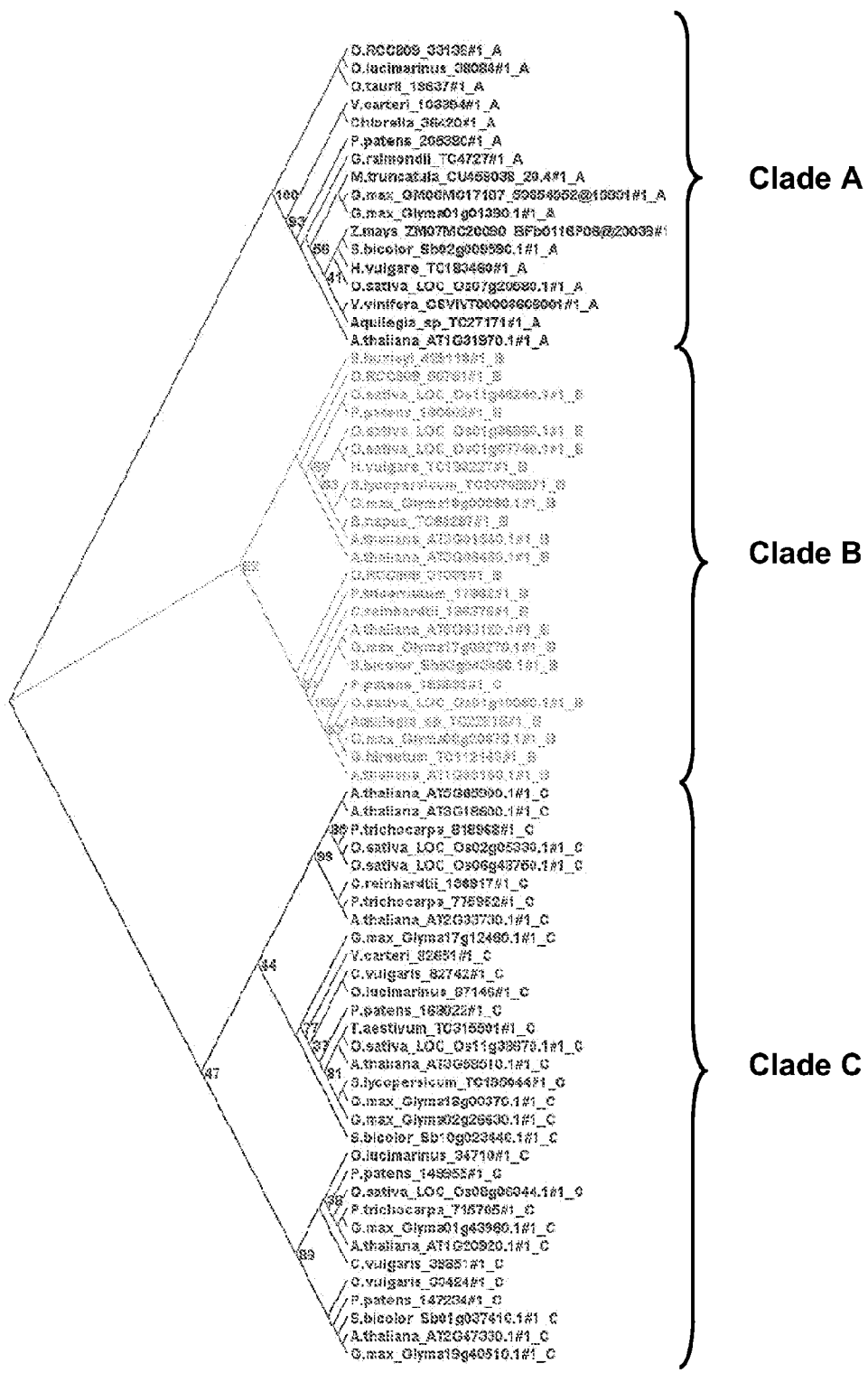
FIG. 3 shows phylogenetic tree of DEAD-box RNA helicase polypeptides, protein sequences used for constructing the tree are referenced by Genbank Accession numbers as described in FIG. 4 of Auburg et al. (1999).

The present invention will now be described with reference to the following examples, which are by way of illustration only. The following examples are not intended to limit the scope of the invention.

DNA Manipulation unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to SEQ ID NO: 1 and SEQ ID NO: 2, or to SEQ ID NO: 168 and SEQ ID NO: 169, or to SEQ ID NO: 291 and SEQ ID NO: 292, were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 1, or SEQ ID NO: 168, or SEQ ID NO: 291 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

1. DEAD-Box RNA Helicase Polypeptide

Table A1 provides a list of nucleic acid sequences related to SEQ ID NO: 1 and SEQ ID NO: 2.

TABLE A1

Examples of DEAD-box RNA helicase nucleic acids and polypeptides:

| Plant Source | Name | Nucleic acid SEQ ID NO: | Protein SEQ ID NO: |
|---|---|---|---|
| O. sativa | | 1 | 2 |
| G. max | | 12 | 13 |
| Z. mays | | 14 | 15 |
| A. thaliana | AT1G31970 | 16 | 17 |
| Aquilegia_sp | TC27171 | 18 | 19 |
| Chlorella | 36420 | 20 | 21 |
| G. max | Glyma01g01390 | 22 | 23 |
| G. raimondii | TC4727 | 24 | 25 |
| H. vulgare | TC183460 | 26 | 27 |
| M. truncatula | CU459038_20.4 | 28 | 29 |
| O. lucimarinus | 38084 | 30 | 31 |
| O.RCC809 | 33138 | 32 | 33 |
| O. taurii | 19637 | 34 | 35 |
| P. patens | 205380 | 36 | 37 |
| S. bicolor | Sb02g009590.1 | 38 | 39 |
| V. carteri | 103394 | 40 | 41 |
| V. vinifera | GSVIVT00003606001 | 42 | 43 |
| A. thaliana | AT1G55150 | 44 | 45 |
| A. thaliana | AT5G63120 | 46 | 47 |

TABLE A1-continued

Examples of DEAD-box RNA helicase nucleic acids and polypeptides:

| Plant Source | Name | Nucleic acid SEQ ID NO: | Protein SEQ ID NO: |
|---|---|---|---|
| Aquilegia_sp | TC22818 | 48 | 49 |
| C. reinhardtii | 136376 | 50 | 51 |
| G. hirsutum | TC112143 | 52 | 53 |
| G. max | Glyma08g20670 | 54 | 55 |
| G. max | Glyma17g09270 | 56 | 57 |
| O.RCC809 | 31039 | 58 | 59 |
| O. sativa | Os01g10050 | 60 | 61 |
| P. tricornutum | 17862 | 62 | 63 |
| S. bicolor | Sb03g043450 | 64 | 65 |
| A.thaliana_ | AT3G01540 | 66 | 67 |
| A.thaliana_ | AT3G06480 | 68 | 69 |
| B. napus | TC64297 | 70 | 71 |
| E. huxleyi | 429118 | 72 | 73 |
| G. max | Glyma19g00260 | 74 | 75 |
| H. vulgare | TC193227 | 76 | 77 |
| O.RCC809 | 50761 | 78 | 79 |
| O. sativa | Os01g07740 | 80 | 81 |
| O. sativa | Os01g36860 | 82 | 83 |
| O. sativa | Os11g46240 | 84 | 85 |
| P. patens | 180402 | 86 | 87 |
| S. lycopersicum | TC207089 | 88 | 89 |
| G. max | Glyma19g40510 | 90 | 91 |
| A. thaliana | AT1G20920 | 92 | 93 |
| A. thaliana | AT2G47330 | 94 | 95 |
| C. vulgaris | 33424 | 96 | 97 |
| C. vulgaris | 39851 | 98 | 99 |
| G. max | Glyma01g43960 | 100 | 101 |
| O. lucimarinus | 34710 | 102 | 103 |
| O. sativa | Os08g06344 | 104 | 105 |
| P. patens | 147234 | 106 | 107 |
| P. patens | 149955 | 108 | 109 |
| P. patens | 182655 | 110 | 111 |
| P. trichocarpa | 715705 | 112 | 113 |
| S. bicolor | Sb01g037410 | 114 | 115 |
| A. thaliana | AT3G18600 | 116 | 117 |
| A. thaliana | AT3G58510 | 118 | 119 |
| A. thaliana | AT5G65900 | 120 | 121 |
| A. thaliana | AT2G33730 | 122 | 123 |
| C. reinhardtii | 136917 | 124 | 125 |
| C. vulgaris | 82742 | 126 | 127 |
| G. max | Glyma02g26630 | 128 | 129 |
| G. max | Glyma17g12460 | 130 | 131 |
| G. max | Glyma18g00370 | 132 | 133 |
| O. lucimarinus | 87146 | 134 | 135 |
| O. sativa | Os06g48750 | 136 | 137 |
| O. sativa | Os11g38670 | 138 | 139 |
| P. patens | 168022 | 140 | 141 |
| P. trichocarpa | 818968 | 142 | 143 |
| S. bicolor | Sb10g023440 | 144 | 145 |
| S. lycopersicum | TC195044 | 146 | 147 |
| T. aestivum | TC315501 | 148 | 149 |
| V. carteri | 82651 | 150 | 151 |
| O. sativa | Os02g05330 | 152 | 153 |
| P. trichocarpa | 775952 | 154 | 155 |

2. CER2-Like Polypeptides

Table A2 provides a list of nucleic acid sequences related to SEQ ID NO: 168 and SEQ ID NO: 169.

TABLE A2

Examples of CER2-like nucleic acids and polypeptides:

| Plant Source | Nucleic acid SEQ ID NO | Protein SEQ ID NO: |
|---|---|---|
| M.truncatula_transferase_CER2-like#1 | 168 | 169 |
| M.truncatula_CU137640_9.3#1 | 170 | 171 |
| G.max_GM06MC00033_47170619@33#1 | 172 | 173 |
| G.max_Glyma02g37870.1#1 | 174 | 175 |

TABLE A2-continued

Examples of CER2-like nucleic acids and polypeptides:

| Plant Source | Nucleic acid SEQ ID NO | Protein SEQ ID NO: |
|---|---|---|
| P.trichocarpa_558994#1 | 176 | 177 |
| Aquilegia_sp_TC23512#1 | 178 | 179 |
| B.napus_BN06MC34354_BNP3363_30@34198#1 | 180 | 181 |
| A.thaliana_AT4G24510.1#1 | 182 | 183 |
| A.thaliana_AT3G23840.1#1 | 184 | 185 |
| A.thaliana_AT4G13840.1#1 | 186 | 187 |
| G.max_Glyma08g11560.1#1 | 188 | 189 |
| P.trichocarpa_549793#1 | 190 | 191 |
| O.basilicum_TA1387_39350#1 | 192 | 193 |
| O.sativa_LOC_Os04g52164.1#1 | 194 | 195 |
| T.aestivum_TC294447#1 | 196 | 197 |
| A.thaliana_AT4G29250.1#1 | 198 | 199 |
| G.max_Glyma17g31040.1#1 | 200 | 201 |
| P.taeda_TA11048_3352#1 | 202 | 203 |
| G.max_Glyma03g40670.1#1 | 204 | 205 |
| Z.mays_ZM07MC26485_BFb0067H12@26407#1 | 206 | 207 |
| P.trichocarpa_757078#1 | 208 | 209 |
| ZmGlossy2 | 210 | 211 |
| A.thaliana_AT1G27620.1#1 | 212 | 213 |
| A.thaliana_AT2G19070.1#1 | 214 | 215 |
| A.thaliana_AT5G41040.1#1 | 216 | 217 |
| A.thaliana_AT5G48930.1#1 | 218 | 219 |
| A.thaliana_AT5G63560.1#1 | 220 | 221 |
| Aquilegia_sp_TC20397#1 | 222 | 223 |
| B.napus_BN06MC25915_51267477@25820#1 | 224 | 225 |
| B.napus_TC72743#1 | 226 | 227 |
| G.hirsutum_TC130878#1 | 228 | 229 |
| G.max_Glyma05g38290.1#1 | 230 | 231 |
| G.max_Glyma08g42490.1#1 | 232 | 233 |
| G.max_Glyma13g44830.1#1 | 234 | 235 |
| G.max_Glyma17g06860.1#1 | 236 | 237 |
| G.max_GM06MC27564_sae62b11@26939#1 | 238 | 239 |
| L.sativa_TC19194#1 | 240 | 241 |
| M.esculenta_TA8094_3983#1 | 242 | 243 |
| M.truncatula_AC148816_16.4#1 | 244 | 245 |
| P.trichocarpa_579978#1 | 246 | 247 |
| P.trichocarpa_587193#1 | 248 | 249 |
| P.trichocarpa_768990#1 | 250 | 251 |
| P.trichocarpa_784746#1 | 252 | 253 |
| P.trichocarpa_807676#1 | 254 | 255 |
| P.trichocarpa_810871#1 | 256 | 257 |
| P.trifoliata_TA5574_37690#1 | 258 | 259 |
| P.vulgaris_TC13456#1 | 260 | 261 |
| S.lycopersicum_TC201861#1 | 262 | 263 |
| V.vinifera_GSVIVT00017176001#1 | 264 | 265 |
| V.vinifera_GSVIVT00035108001#1 | 266 | 267 |
| S.moellendorffii_431283#1 | 268 | 269 |
| P.patens_TC44371#1 | 270 | 271 |

3. At1g68440-Like Polypeptides

Table A3 provides a list of nucleic acid sequences related to SEQ ID NO: 291 and SEQ ID NO: 292.

TABLE A3

Examples of At1g68440-like nucleic acids and polypeptides (Examples highlighted in grey refer to the group of Clade A (SEQ ID NOs: 291-320)):

| Plant Source | Nucleic acid SEQ ID NO: | Protein SEQ ID NO: |
|---|---|---|
| At1g68440-like (Pt putative IMP dehydrogenase) | 291 | 292 |
| C.clementina_DY272345#1 | 293 | 294 |
| C.clementina_TC10465#1 | 295 | 296 |
| C.clementina_TC18948#1 | 297 | 298 |
| C.clementina_TC31598#1 | 299 | 300 |
| G.hirsutum_TC134197#1 | 301 | 302 |
| P.trichocarpa_769638#1 | 303 | 304 |

TABLE A3-continued

Examples of At1g68440-like nucleic acids and polypeptides
(Examples highlighted in grey refer to the group
of Clade A (SEQ ID NOs: 291-320)):

| Plant Source | Nucleic acid SEQ ID NO: | Protein SEQ ID NO: |
|---|---|---|
| P.trichocarpa__832731#1 | 305 | 306 |
| P.trifoliata__TA5851__37690#1 | 307 | 308 |
| R.communis__TA1965__3988#1 | 309 | 310 |
| A.lyrata__475964#1 | 311 | 312 |
| A.lyrata__921679#1 | 313 | 314 |
| A.thaliana__AT1G25400.1#1 | 315 | 316 |
| A.thaliana__AT1G68440.1#1 | 317 | 318 |
| Aquilegia__sp__TC24194#1 | 319 | 320 |
| Aquilegia__sp__TC25879#1 | 321 | 322 |
| G.max__Glyma10g41960.1#1 | 323 | 324 |
| G.max__TC278929#1 | 325 | 326 |
| G.max__TC339602#1 | 327 | 328 |
| H.paradoxus__TA2948__73304#1 | 329 | 330 |
| H.petiolaris__DY945986#1 | 331 | 332 |
| L.japonicus__TC42314#1 | 333 | 334 |
| L.saligna__DW067807#1 | 335 | 336 |
| L.sativa__TC23070#1 | 337 | 338 |
| L.serriola__TC6013#1 | 339 | 340 |
| L.virosa__DW158350#1 | 341 | 342 |
| M.domestica__TC34673#1 | 343 | 344 |
| M.truncatula__AC135604__14.4#1 | 345 | 346 |
| N.tabacum__TC41632#1 | 347 | 348 |
| O.basilicum__TA1347__39350#1 | 349 | 350 |
| P.vulgaris__TC13663#1 | 351 | 352 |
| S.lycopersicum__TC193481#1 | 353 | 354 |
| T.officinale__TA2631__50225#1 | 355 | 356 |
| T.versicolor__TC2688#1 | 357 | 358 |
| V.vinifera__GSVIVT00030351001#1 | 359 | 360 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

Example 2

Alignment of Sequences Related to the Polypeptide Sequences Used in the Methods of the Invention 1. DEAD-Box RNA Helicase Polypeptide Alignment of polypeptide sequences was performed using MAFT (Katoh et al. (2008), Briefings in Bioinformatics 9:286-298).

Alignment of polypeptide sequences was performed using the ClustalW 2.0 algorithm of progressive alignment (Thompson et al. (1997), Nucleic Acids Res 25:4876-4882; Chema et al. (2003), Nucleic Acids Res 31:3497-3500) with standard setting (slow alignment, similarity matrix: Gonnet or Blosum 62 (if polypeptides are aligned), gap opening penalty 10, gap extension penalty: 0.2. Minor manual editing was done to further optimise the alignment. The DEAD-box RNA helicase polypeptides are aligned in FIG. 2.

A phylogenetic tree of DEAD-box RNA helicase polypeptides (FIG. 3) was constructed using a neighbour-joining clustering algorithm as provided in QuickTree 1.1 (Houwe et al. (2002). Bioinformatics 18(11):1546-7) using Dendroscope2.0.1 (Huson et al. (2007). Bioinformatics 8(1):460). The proteins were aligned using MAFT (Katoh and Toh (2008). Briefings in Bioinformatics 9:286-298).

2. CER2-Like Polypeptides

Figure 9:
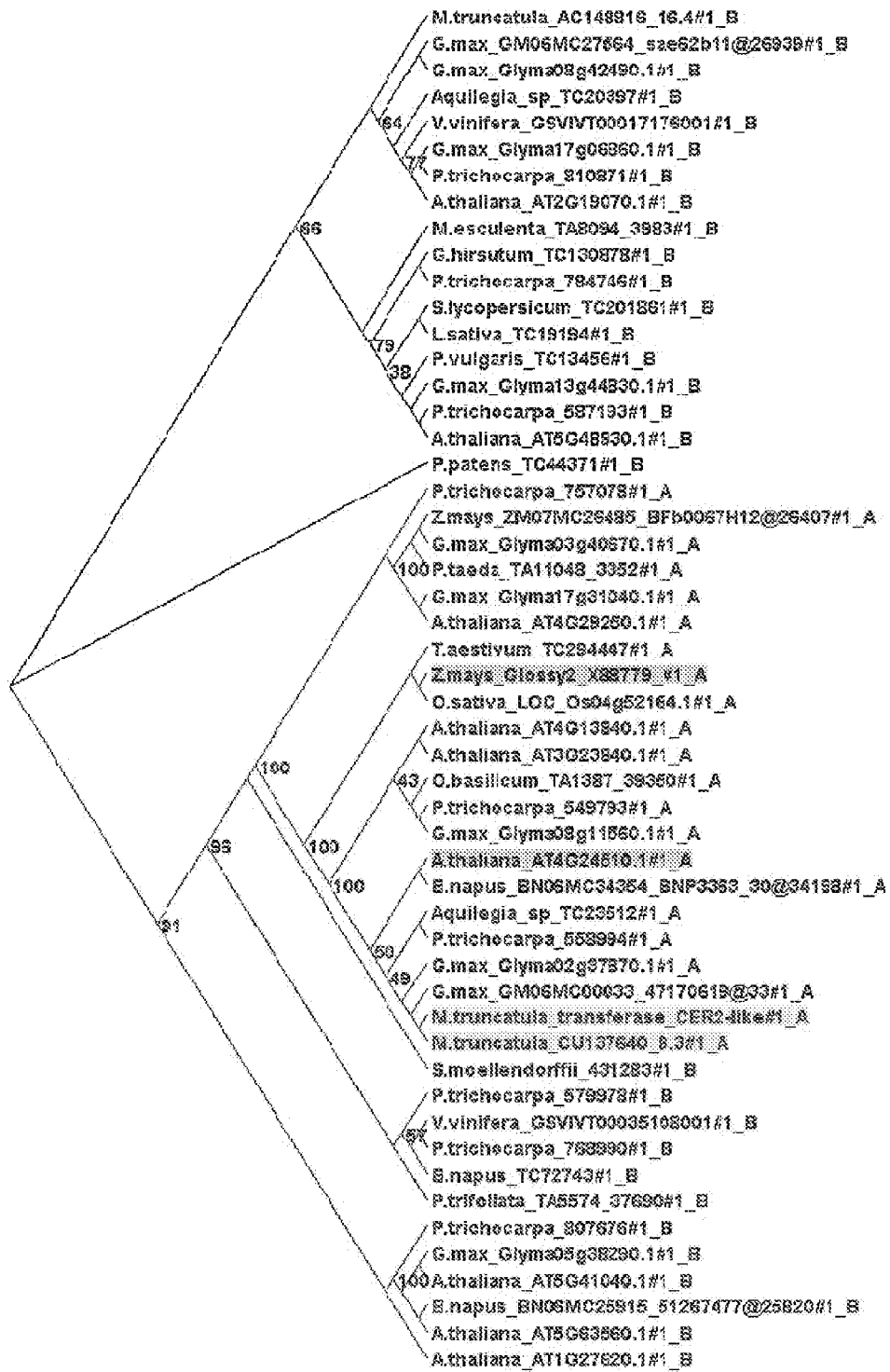
FIG. 9 shows phylogenetic tree of CER2-like polypeptides, Phylogenetic relationship of CER-like related proteins. The proteins were aligned using MAFT (Katoh and Toh (2008). Briefings in Bioinformatics 9:286-298). A neighbour-joining tree was calculated using QuickTree1.1 (Houwe et al. (2002). Bioinformatics 18(11):1546-7). A cladodrogram was drawn using Dendroscope2.0.1 (Huson et al. (2007). Bioinformatics 8(1):460). At e=1e-10, Arabidopsis transferase genes were recovered. The tree was generated using representative members of each cluster. The preferred CER2-like polypeptide is M. truncatula_transferase_CER2-like#1 gene from Medicago truncatula and its closely related homolog are indicated in red lines and highlighted in yellow in the tree. Arabidopsis CER2 and maize Glossy2 both involved in cuticlar wax biosynthesis are highlighted in green.

A phylogenetic tree of CER2-like polypeptides (FIG. 9) was constructed using a neighbour-joining clustering algorithm as provided in the AlignX programme from the Vector NTI (Invitrogen).

The alignment was generated using MAFFT (Katoh and Toh (2008)—Briefings in Bioinformatics 9:286-298). A neighbour-joining tree was calculated using Quick-Tree (Howe et al. (2002), Bioinformatics 18(11): 1546-7), 100 bootstrap repetitions. The circular phylogram was drawn using Dendroscope (Huson et al. (2007), BMC Bioinformatics 8(1):460). Confidence for 100 bootstrap repetitions is indicated for major branching.

3. At1g68440-Like Polypeptides

Figure 14:
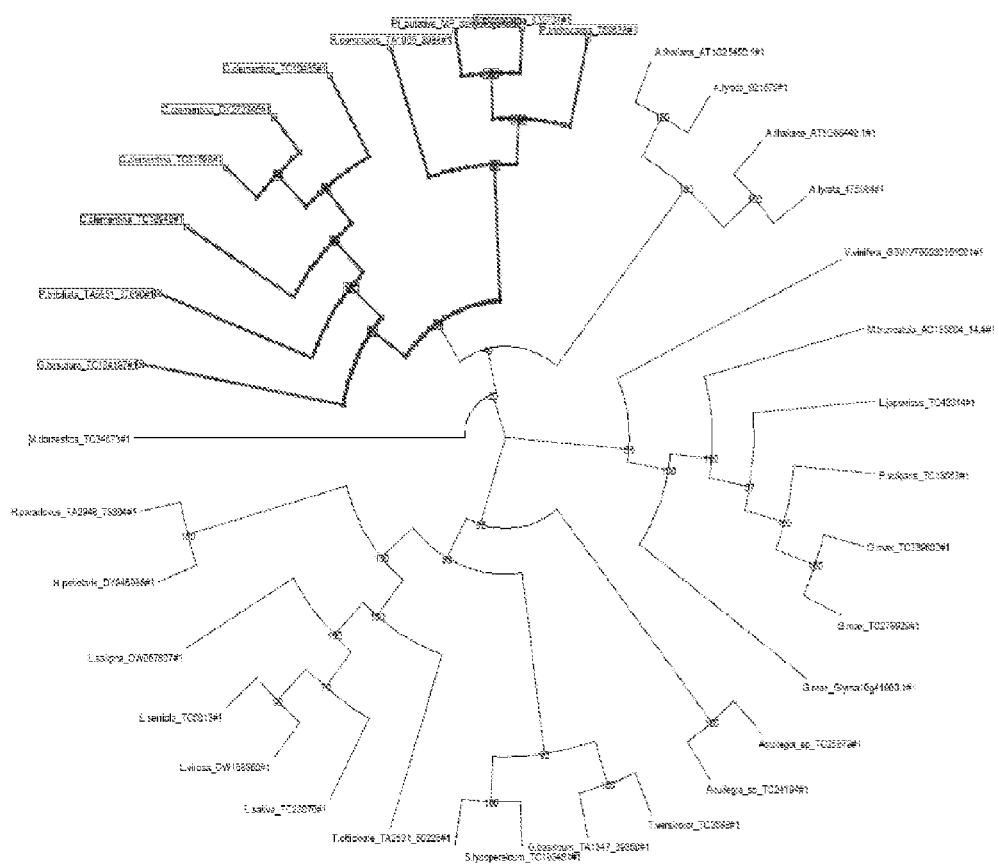
FIG. 14 shows phylogenetic tree of At1g68440-like polypeptides.

A phylogenetic tree of At1g68440-like polypeptides (FIG. 14) was constructed using a neighbour-joining clustering algorithm as provided in the AlignX programme from the Vector NTI (Invitrogen).

The alignment was generated using MAFFT (Katoh and Toh (2008)—Briefings in Bioinformatics 9:286-298). A neighbour-joining tree was calculated using Quick-Tree (Howe et al. (2002), Bioinformatics 18(11): 1546-7), 100 bootstrap repetitions. The circular phylogram was drawn using Dendroscope (Huson et al. (2007), BMC Bioinformatics 8(1):460)—FIG. 13. Confidence for 100 bootstrap repetitions is indicated for major branching.

Example 3

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

1. DEAD-Box RNA Helicase Polypeptide

As an example, results of the software analysis of selected DEAD-box RNA helicases of Table A1, i.e. the sequences of clade A in FIG. 3, are shown in FIG. 4 for the global similarity and identity over the full length of the polypeptide sequences. Sequence similarity is shown in the bottom half of the dividing line and sequence identity is shown in the top half of the diagonal dividing line. Parameters used in the comparison were: Scoring matrix: Blosum62, First Gap: 12, Extending Gap: 2. The sequence identity (in %) between the DEAD-box RNA helicase polypeptide sequences useful in performing the methods of the invention can be as low as 45% (is generally higher than 45%) compared to SEQ ID NO: 2.

TABLE B1

Description of proteins in FIG. 4
DEAD-box RNA helicase Protein. Plant Source_Chomosome locus 1. A.thaliana__AT1G31970
2. Aquilegia_sp__TC27171
3. Chlorella__36420
4. G.max__Glyma01g01390
5. G.max__GM06MC17187__59654952@16891#1__A
6. G.raimondii__TC4727
7. H.vulgare__TC183460
8. M.truncatula__CU459038__20
9. O.lucimarinus__38084
10. O.RCC809__33138
11. O.sativa__LOC__Os07g20580
12. O.taurii__19637
13. P.patens__205380
14. S.bicolor__Sb02g009590
15. V.carter__103394
16. V.vinifera__GSVIVT00003606001
17. Z.mays__ZM07MC20090__BFb0116P06@20039#1__A 2. CER2-Like Polypeptides Results of the software analysis are shown in FIG. 10 for the global similarity and identity over the full length of the polypeptide sequences. Sequence similarity is shown in the bottom half of the dividing line and sequence identity is shown in the top half of the diagonal dividing line. Parameters used in the comparison were: Scoring matrix: Blosum62, First Gap: 12, Extending Gap: 2. The sequence identity (in %) between the CER2-like polypeptide sequences useful in performing the methods of the invention is generally higher than 16% compared to SEQ ID NO: 169.

3. At1g68440-Like Polypeptides

Results of the software analysis are shown in FIG. 15 for the global similarity and identity over the full length of the polypeptide sequences. Sequence similarity is shown in the bottom half of the dividing line and sequence identity is shown in the top half of the diagonal dividing line. Parameters used in the comparison were: Scoring matrix: Blosum62, First Gap: 12, Extending Gap: 2. The sequence identity (in %) between the At1g68440-like polypeptide sequences useful in performing the methods of the invention can be as low as 21% compared to SEQ ID NO: 292.

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

1. DEAD-Box RNA Helicase Polypeptide

The results of the InterPro scan of the polypeptide sequence as represented by SEQ ID NO: 2 are presented in Table C1.

TABLE C1

InterPro scan results (major accession numbers) of the polypeptide sequence as represented by SEQ ID NO: 2.

| Interpro ID | Domain ID | Domain name | Amino acid coordinates on SEQ ID NO 2: e-value [amino acid position of the domain] |
|---|---|---|---|
| IPR000629 | PS00039 PROSITE | RNA helicase, ATP-dependent, DEAD-box, conserved site | 0.0 [246-254]T |
| IPR001650 | PF00271 PFAM0 | DNA/RNA helicase, C-terminal | 7.8E−31 [361-437]T |
|  | SM00490 SMART | DNA/RNA helicase, C-terminal | 1.9E−30 [356-437]T |
|  | PS51194 PROFILE | DNA/RNA helicase, C-terminal | 0.0 [333-476]T |
| IPR0011545 | PF00270 PFAM | DNA/RNA helicase, DEAD/DEAH box type, N-terminal | 8.3E−65 [116-289]T |
| IPR014001 | SM00487 SMART | DEAD-like helicase, N-terminal | 8.6E−66 [111-317]T |
| IPR014014 | PS51195 PROFILE | RNA helicase, DEAD-box type, Q motif | 0.0 [94-120]T |
| IPR014021 | PS51192 PROFILE | Helicase, superfamily 1 and 2, ATP-binding | 0.0 [123-300]T |
| unintegrated | G3DSA:3.40.50.300 GENE3D | unintegrated | 2.9E−64 [81-311]T 4.2E−42 [311-477]T |
|  | PTHR10967 PANTHER | unintegrated | 0.0 [92-494]T 0.0 [92-494]T |
|  | PTHR10967:SF50 PANTHER | unintegrated | 0.0 [92-494]T 0.0 [92-494]T |
|  | SSF52540 SUPERFAMILY | unintegrated | 2.7E−60 [11-457]T 6.2E−43 [310-472]T |

2. CER2-Like Polypeptides

The results of the InterPro scan of the polypeptide sequence as represented by SEQ ID NO: 169 are presented in Table C2.

TABLE C2

InterPro scan results (major accession numbers) of the polypeptide sequence as represented by SEQ ID NO: 169.

| Interpro ID | Domain ID | Domain name | Short Name | Location |
|---|---|---|---|---|
| IPRO003480 | PF02458 PFAM | Transferase | Transferase | 8.6E−15 [73−189]T |
| unintegrated | G3DSA:3.30.559.20 GENE3D | unintegrated | G3DSA:3.30.559.20 | 9.6E−31 [16−192]T |

3. At1g68440-Like Polypeptides

The results of the InterPro scan of the polypeptide sequence as represented by SEQ ID NO: 292 are presented in Table C3.

TABLE C2

InterPro scan results of the polypeptide sequence as represented by SEQ ID NO: 292.

| Protein length | Transmembrane region | E-value | Amino acid coordinates on SEQ ID NO 292 |
|---|---|---|---|
| 332 | TMHMM | NA | Start: 46; Stop: 64 |

Example 5

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters can be selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:

ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Assay Related to the Polypeptide Sequences Useful in Performing the Methods of the Invention 1. DEAD-Box RNA Helicase Polypeptide Tools and techniques for measuring helicase activity are e.g. described in Okanami et al. (1998) Nucleic Acid Res. (26): 2638-2643.

2. CER2-Like Polypeptides

A radioisotopic assay for DAT can be adapted from De Luca et al., 1985, J. Plant Physiol. Vol 121, pages 417-428. The assay buffer which can contain DTT can be replaced with Buffer B containing ascorbate, resulting in DAT enzyme assays with decreased background radioactivity. The assay mixture can contain 10 µl of protein solution (of various concentrations), 18 µM deacetylvindoline, and 37 µM [I-14C]acetylcoenzyme A (sp act 54 mCi/mmol) and Buffer B in a final volume of 100 µl. Assays can be performed in 1.5 ml Eppendorf micro test tubes. After 10 min in a 30° C. water bath, the reaction can be stopped with 100 µl of 0.1 M NaOH. The radiolabeled product ([14C] vindoline) can be extracted with 250 µl of ethyl acetate for 5 min on an Eppendorf Model 5432 mixer. The aqueous and organic phases can be separated by centrifugation for 2 min in an Eppendorf Model 235C microcentrifuge at 13,000 rpm. One hundred microliters of the organic phase from each assay can be mixed with 2.5 ml of 0.4% PPO in toluene and assays can be counted for 1 min using an LKB 1219 Rackbeta liquid scintillation counter.

Example 7

Cloning of the Nucleic Acid Sequence Used in the Methods of the Invention

1. DEAD-Box RNA Helicase Polypeptide

The *Oryza sativa* DEAD-box RNA helicase nucleic acid sequence was amplified by PCR using as template an *Oryza sativa* seedlings cDNA library (Invitrogen, Paisley, UK). After reverse transcription of RNA extracted from seedlings, the cDNAs were cloned into pCMV Sport 6.0. Average insert size of the bank was 1.5 kb and the original number of clones was of the order of $1.59 \times 10^7$ cfu. Original titer was determined to be $9.6 \times 10^5$ cfu/ml after first amplification of $6 \times 10^{11}$ cfu/ml. After plasmid extraction, 200 ng of template was used in a 50 µl PCR mix. Primers prm14820 (SEQ ID NO: 157; sense: 5'-ggggacaagtttgtacaaa aaagcaggcttaaacaatgggtcgcagtatgcttc-3') and prm14821 (SEQ ID NO: 158; reverse, complementary: 5'-ggggaccactttgta-caagaaagctgggtacgaagaaaagaccagcaaat-3'), which include the AttB sites for Gateway recombination, were used for PCR amplification. PCR was performed using Hifi Taq DNA polymerase in standard conditions. A PCR fragment of the expected size was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination (such that the sequence of interest from the entry clone is integrated in sense or anti sense orientation) with the nucleic acid sequence of interest already cloned in the entry clone. A rice GOS2 promoter (SEQ ID NO: 156) for constitutive specific expression was located upstream of this Gateway cassette.

Figure 5:
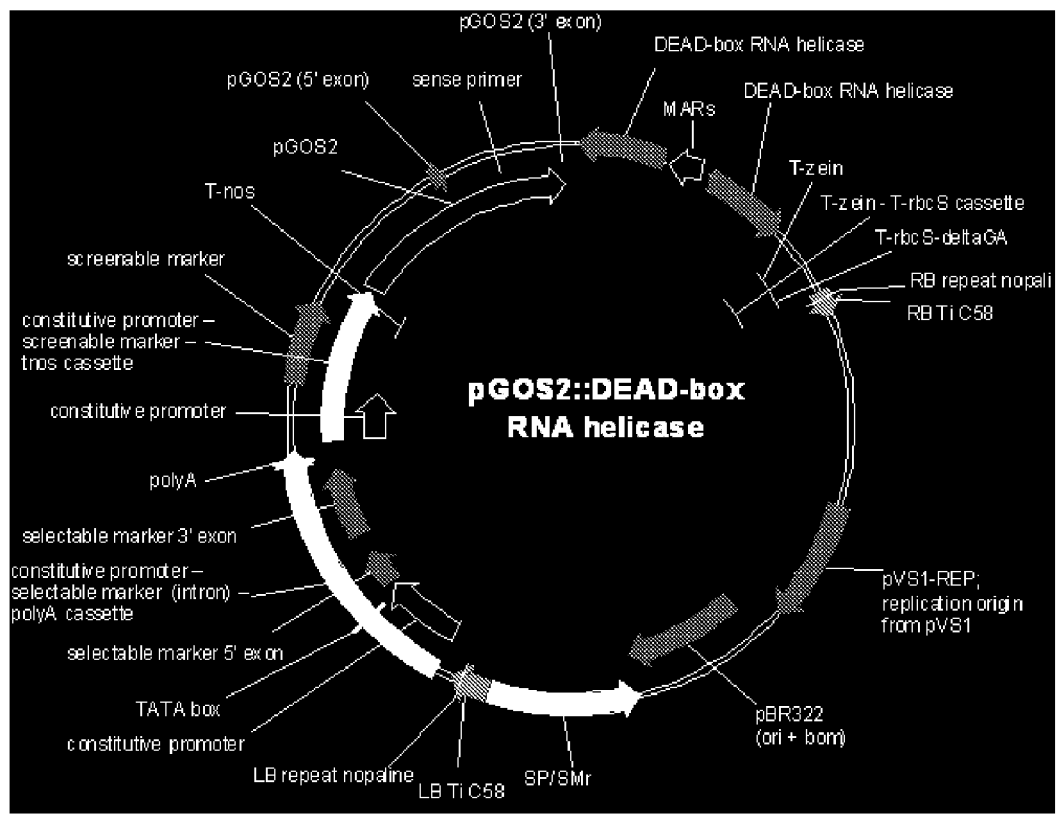
FIG. 5 represents the binary vector used for Os DEAD-box RNA helicase RNA silencing in Oryza sativa, using a hairpin construct under the control of a rice GOS2 promoter (pGOS2).
Figure 6:
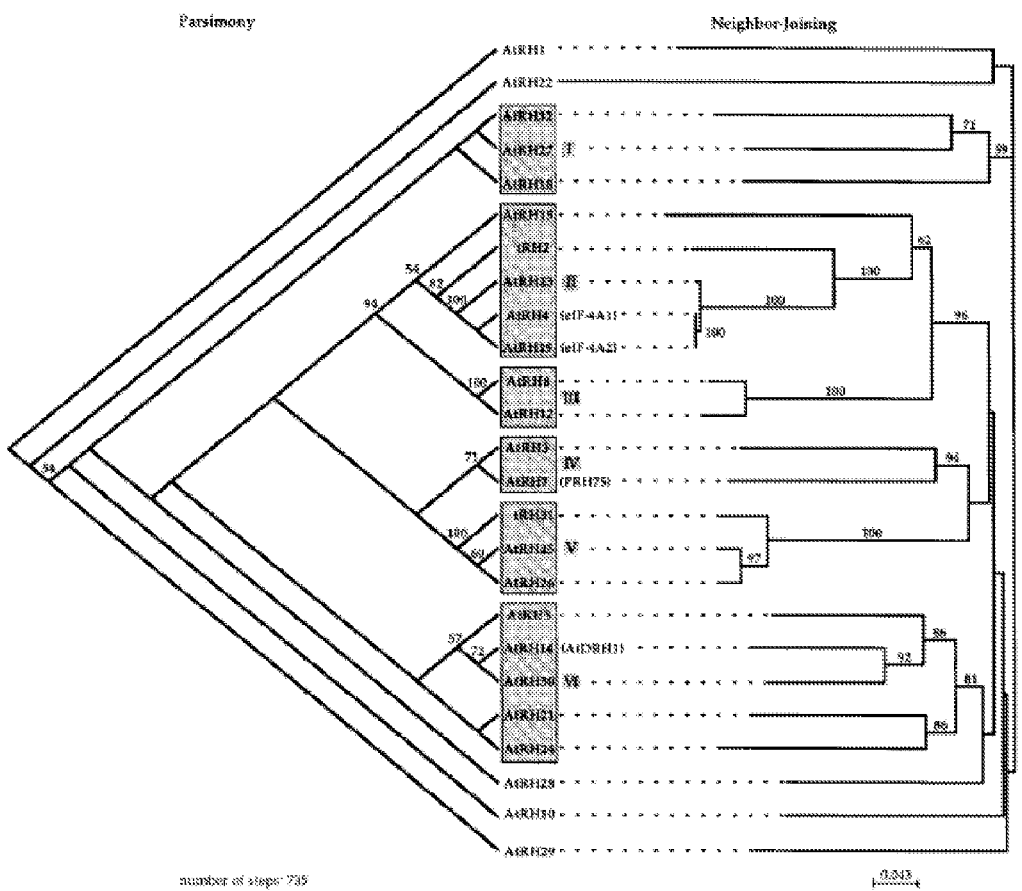
FIG. 6 shows the neighbour-joining phylogenetic tree DEAD-box RNA helicase family in Arabidopsis as published by Auburg et al. (1999). The different subfamilies in which the DEAD-box RNA helicases are classified, including subfamily VI are indicated.

After the LR recombination step, the resulting expression vector pGOS2::DEAD-box RNA helicase (FIG. 5) was transformed into *Agrobacterium* strain LBA4044 according to methods well known in the art.

2. CER2-Like Polypeptides

The nucleic acid sequence was amplified by PCR using as template a custom-made *Medicago truncatula* seedlings cDNA library. PCR was performed using Hifi Taq DNA polymerase in standard conditions, using 200 ng of template in a 50 µl PCR mix. The primers used were prm13662 (SEQ ID NO: 272; sense): 5'-ggggacaagtttgtacaaaaaagca ggct-taaacaatgggttcattgccaaattta-3' and prm13663 (SEQ ID NO: 273; reverse, complementary): 5'-ggggaccactttgta-caagaaagctgggtcacaacacaattccaccaact-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pCER2-like. Plasmid pDONR201 was purchased from Invitrogen, as part of the Gateway® technology.

The entry clone comprising SEQ ID NO: 168 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 289) for constitutive specific expression was located upstream of this Gateway cassette.

Figure 11:
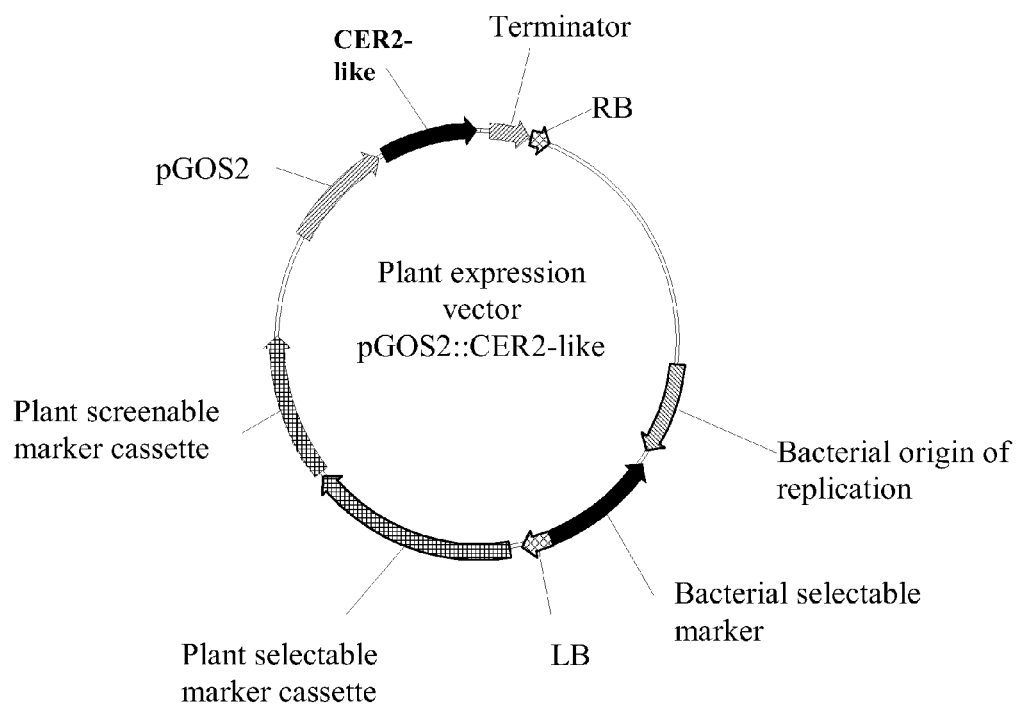
FIG. 11 represents the binary vector used for increased expression in Oryza sativa of a CER2-like-encoding nucleic acid under the control of a rice GOS2 promoter (pGOS2).

After the LR recombination step, the resulting expression vector pGOS2::CER2-like (FIG. 11) was transformed into *Agrobacterium* strain LBA4044 according to methods well known in the art.

3. At1g68440-Like Polypeptides

The nucleic acid sequence was amplified by PCR using as template a custom-made *Populus trichocarpa* seedlings cDNA library. PCR was performed using Hifi Taq DNA polymerase in standard conditions, using 200 ng of template in a 50 µl PCR mix. The primers used were prm14292: (SEQ ID NO: 361; sense): 5'-ggggacaagtttgtacaaaaaag caggct-taaacaatggagatcccagtgatcaat-3' and prm14293: (SEQ ID NO: 362; reverse, complementary): 5'-ggggaccactttgta-caagaaagctgggtccgcgttatcaaacagattt-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pAt1g68449. Plasmid pDONR201 was purchased from Invitrogen, as part of the Gateway® technology.

The entry clone comprising SEQ ID NO: 291 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 363) for constitutive specific expression was located upstream of this Gateway cassette.

Figure 16:
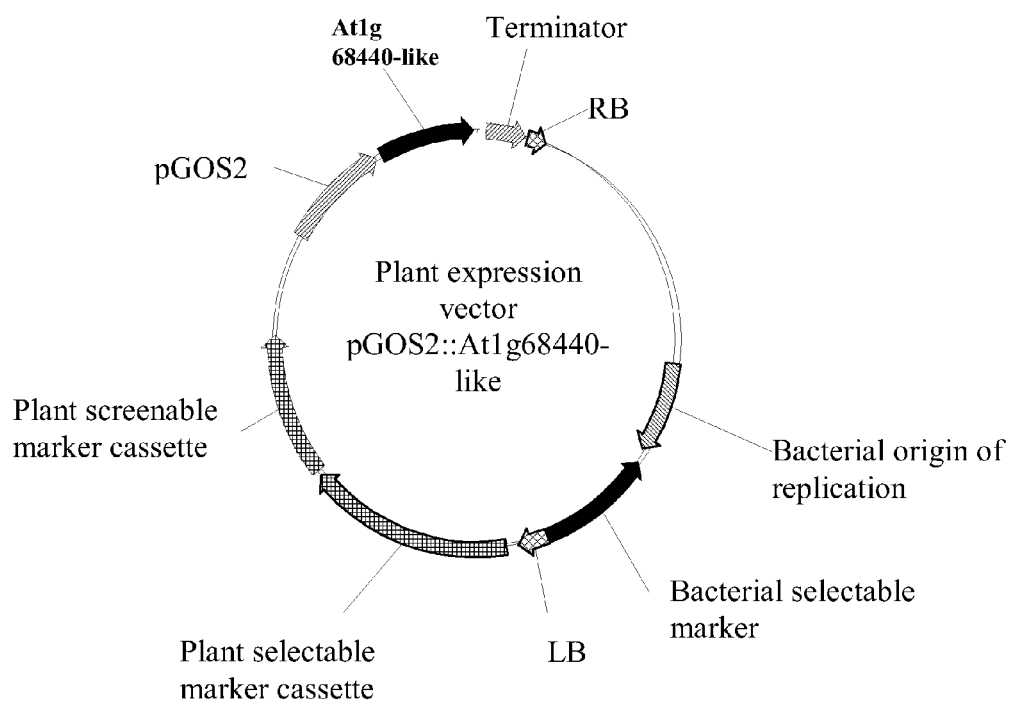
FIG. 16 represents the binary vector used for increased expression in Oryza sativa of a At1g68440-like-encoding nucleic acid under the control of a rice GOS2 promoter (pGOS2).

After the LR recombination step, the resulting expression vector pGOS2::At1g68440-like (FIG. 16) was transformed into *Agrobacterium* strain LBA4044 according to methods well known in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Example 9

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7 Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 µg/ml cefotaxime. The seeds are then transferred to SH-medium with 50 µg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup
1. DEAD-Box RNA Helicase Polypeptide Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

From the stage of sowing until the stage of maturity the plants were passed several times through a digital imaging cabinet. At each time point digital images (2048×1536 pixels, 16 million colours) were taken of each plant from at least 6 different angles.

2. CER2-Like Polypeptides

Approximately 35 independent T0 rice transformants were generated. The primary transformants were transferred from a tissue culture chamber to a greenhouse for growing and harvest of T1 seed. Five events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions are watered at regular intervals to ensure that water and nutrients are not limiting and to satisfy plant needs to complete growth and development.

From the stage of sowing until the stage of maturity the plants are passed several times through a digital imaging cabinet. At each time point digital images (2048×1536 pixels, 16 million colours) were taken of each plant from at least 6 different angles.

T1 events can be further evaluated in the T2 generation following the same evaluation procedure as for the T1 generation, e.g. with less events and/or with more individuals per event.

3. At1g68440-Like Polypeptides

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

From the stage of sowing until the stage of maturity the plants were passed several times through a digital imaging cabinet. At each time point digital images (2048×1536 pixels, 16 million colours) were taken of each plant from at least 6 different angles.

T1 events can be further evaluated in the T2 generation following the same evaluation procedure as for the T1 generation, e.g. with less events and/or with more individuals per event.

Drought Screen
1. DEAD-Box RNA Helicase Polypeptide

Plants from T1 seeds were grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions.

2. CER2-Like Polypeptides

Plants from T2 seeds were grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions.

3. At1g68440-Like Polypeptides

Plants from T2 seeds are grown in potting soil under normal conditions until they approached the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T1 or T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

10.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

10.3 Parameters Measured

From the stage of sowing until the stage of maturity the plants were passed several times through a digital imaging cabinet. At each time point digital images (2048×1536 pixels, 16 million colours) were taken of each plant from at least 6 different angles as described in WO2010/031780. These measurements were used to determine different parameters.

Biomass-Related Parameter Measurement

The plant aboveground area or leafy biomass was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass.

The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Increase in root biomass is expressed as an increase in total root biomass (measured as maximum biomass of roots observed during the lifespan of a plant); or as an increase in the root/shoot index, which is measured as the ratio between root mass and shoot mass in the period of active growth of root and shoot. Root biomass can be determined using a method as described in WO 2006/029987.

Parameters Related to Development Time

The early vigour is the plant, i.e. seedling, aboveground area three weeks post-germination. Early vigour was determined by counting the total number of pixels from aboveground plant parts discriminated from the background. This value was averaged for the pictures taken on the same time point from different angles and was converted to a physical surface value expressed in square mm by calibration.

AreaEmer is an indication of quick early development (when decreased compared to control plants). It is the ratio (expressed in %) between the time a plant needs to make 30% of the final biomass and the time a plant needs to make 90% of its final biomass.

The "flowering time" of the plant can be determined using the method as described in WO 2007/093444.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed weight, was measured by weighing all filled husks harvested from a plant. Total seed number per plant was measured by counting the number of husks harvested from a plant. Thousand Kernel Weight, or TKW, is extrapolated from the number of filled seeds counted and their total weight. The Harvest Index, or HI, in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Root biomass can be determined using a method as described in WO 2006/029987.

Example 11

Results of the Phenotypic Evaluation of the Transgenic Plants

1. DEAD-Box RNA Helicase Polypeptide

The results of the evaluation of transgenic rice plants in the T1 generation and expressing a nucleic acid comprising the longest Open Reading Frame in SEQ ID NO: 1 under drought conditions are presented below. See previous Examples for details on the generations of the transgenic plants.

The results of the evaluation of transgenic rice plants under drought stress conditions are presented below. An increase of at least 5% was observed for total seed yield including total weight of seeds, number of filled seeds, fill rate, and harvest index, and of more than 2.5% for thousand kernel weight.

The results of the evaluation of transgenic rice plants expressing a DEAD-box RNA helicase nucleic acid under drought-stress conditions are presented hereunder (Table D1).

Example

The results of the evaluation of transgenic rice plants in the T1 generation and expressing a nucleic acid encoding the DEAD-box RNA helicase polypeptide of SEQ ID NO: 2 under drought stress conditions are presented below in Table D1. When grown under drought stress conditions, An increase of at least 5% was observed for total seed yield including total weight of seeds, number of filled seeds, fill rate, and harvest index.

TABLE D1

Data summary for transgenic rice plants on drought; for each parameter, the overall percent increase is shown if the parameter reaches a p-value of p < 0.05 and abovethe 5% treshold.

| Parameter | Overall increase |
|---|---|
| Total weight of seeds | 23.2 |
| Number of filled seeds | 19.1 |
| Fill rate | 35.0 |
| Harvest index | 25.3 |

2. CER2-Like Polypeptides

The results of the evaluation of transgenic rice plants expressing an CER2-like nucleic acid under drought-stress conditions are presented hereunder. An increase of at least 5% was observed for total seed weight, number of filled seeds, fill rate, harvest index, and gravity centre of the leafy biomass of a plant (Table D2). AreaCycl is a measure of the time elapse between sowing and the emergence of the first panicle of a plant, that is, the period of accruing biomass of a plant. It is calculated as the time (in days) needed between sowing and the day the plant reaches 90% of its final biomass. It is typically used as a measure for estimating the growth rate of a plant.

TABLE D2

Data summary for transgenic rice plants; for each parameter, the overall percent increase is shown for the confirmation (T1 generation), for each parameter the p-value is <0.05.

| Parameter | Overall increase |
|---|---|
| totalwgseeds | 52.1 |
| fillrate | 54.2 |
| harvestindex | 49.7 |
| nrfilledseed | 46.9 |
| GravityYMax | 5.3 |
| AreaCycl | 5.4 |

3. At1g68440-Like Polypeptides

The results of the evaluation of transgenic rice plants in the T1 generation and expressing a nucleic acid comprising the longest Open Reading Frame in SEQ ID NO: 291 under non-stress conditions are presented below. See previous Examples for details on the generations of the transgenic plants.

The results of the evaluation of transgenic rice plants under non-stress conditions are presented below. An increase of at least 5% was observed for total seed yield, number of filled seeds, fill rate, number of flowers per panicle, harvest index, total seed weight, and of (2.5-3)% for thousand kernel weight The results of the evaluation of transgenic rice plants expressing an At1g68440-like nucleic acid under drought-stress conditions are presented hereunder. An increase was observed for total seed weight, number of filled seeds, fill rate, harvest index and thousand-kernel weight (Table D3).

The results of the evaluation of transgenic rice plants in the T1 generation and expressing a nucleic acid encoding the At1g68440-like polypeptide of SEQ ID NO: 292 under non-stress conditions are presented below in Table D3. When grown under non-stress conditions, an increase of at least 5% was observed for seed yield (total weight of seeds, number of filled seeds, fill rate, harvest index).

TABLE D3

Data summary for transgenic rice plants; for each parameter, the overall percent increase is shown for the confirmation (T1 generation), for each parameter the p-value is <0.05.

| Parameter | Overall increase |
|---|---|
| totalwgseeds | 38.1 |
| fillrate | 28.5 |
| harvestindex | 34.4 |
| nrfilledseed | 32.7 |

SEQUENCE LISTING (375 sequences)

SEQ ID NO: 1 - DNA, 1539 bp, Oryza sativa
atgggtcgcagtatgcttcccgagcagcaggaggacgtatcgaggaagagcaagaaggagaagaagagcaagaaagacaagaagcggaagctggaggcggaggccgaggtggtggtggtggaggcggctgcggccacgtccacggatgaagcgacgaagagcagcaagaagaagagggccaagggcgatctgggccaaggagaggaggcggagaacggcggtgggaaggtcgtggccgtgaccgggaagggctccgcggacgccaagtacgccccgctgtcatccttcgccgccaccgcgcttcctccccaggtgctcgactgctgcaaggggttcgagcgtccgtcgcccatccaagcgtacgcctggccttacctcctcgacggtcgtgacttcatcggcatcgccgccaccggatctgggaagacgattgcgtttggtgtgccggctctgatgcacgttaggaggaaaatgggggagaaatctgctaagaagggggtgccacgggtcctcgtgctatcgccaacgagagagcttgctcagcagatcgcagatgtactttgtgaagctggtgcaccatgtgggataagttcagtgtgcctttatggtggaacttccaaaggaccacaaatttctgcccttaaatctggagtggatattgtcatagggacacctggtcgtatgaaagaccttattgaaatgggtatttgtcgtcttaatgatgtttcttttgtggttctagatgaagctgatcgaatgctggatatgggttttgaacctgaagtcagagcaattttaagccaaactgcatctgtacgtcagacggttatgttcagtgctacatggcctcctgctgtccaccagctagcccaagagtttatggatccaaatccaataaaggttgttattggatcagaagatcttgctgctaaccatgatgtgatgcaaattgttgaagtattggatgacaggtcaagggattcaagattagttgctttgctcgataaataccataaagcacagagaaacagggtgttggtttttgtgttgtacaagagagaagctacgcgagtagaaacaatgttacaaagaaggggttggagtgctgtttctgttcatggagataaggcacagcatgacaggacgaaagctttatctttatttaaagaagggtcatgtcctttgatgattgccactgatgtcgcatcccgtggacttgatattccagatgtcgaagttgtcattaactatagctatcctttgactacagaggattatgtccacaggattgggaggaccggtcgtgctggcaagaaaggtgttgcacataccttcttcactcaagagaacaagggacttgctggtgaacttgtcaatgttttgcgggaggctggtcaggtcgttcctcctgcacttacaaaatttggcacacacgtcaagaaaaaggaatcgcaaatatatggatctcatttcaaagaaatcaaagcagatgctcctaaatcaacaaagattacgtttggtgattctgatgaggactag

SEQ ID NO: 2 - protein, 512 aa, Oryza sativa
MGRSMLPEQQEDVSRKSKKEKKSKKDKKRKLEAEAEVVVVEAAAATSTDEATKSSKKKRAKGDLGQGEEAENGGGKVVAVTGKGSADAKYAPLSSFAATALPPQVLDCCKGFERPSPIQAYAWPYLLDGRDFIGIAATGSGKTIAFGVPALMHVRRKMGEKSAKKGVPRVLVLSPTRELAQQIADVLCEAGAPCGISSVCLYGGTSKGPQISALKSGVDIVIGTPGRMKDLIEMGICRLNDVSFVVLDEADRMLDMGFEPEVRAILSQTASVRQTVMFSATWPPAVHQLAQEFMDPNPIKVVIGSEDLAANHDVMQIVEVLDDRSRDSRLVALLDKYHKAQRNRVLVFVLYKREATRVETMLQRRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 3 - protein, 41 aa, Artificial sequence
  MEME motif A + B + C
  VARIANT (1)..(1): / replace = "Met"
  VARIANT (2)..(2): / replace = "Ile"
  VARIANT (13)..(13): / replace = "Val"
  VARIANT (14)..(14): / replace = "Pro"
  VARIANT (16)..(16): / replace = "Ile"
  VARIANT (17)..(17): / replace = "Lys"
  VARIANT (20)..(20): / replace = "Val"
  VARIANT (22)..(22): / replace = "Phe"
  VARIANT (26)..(26): / replace = "Asn"
  VARIANT (27)..(27): / replace = "Asp"
  VARIANT (28)..(28): / replace = "Thr"
  VARIANT (29)..(29): / replace = "Asp"
LVATDVAARGLDIKDVEVVINYDFPLTIEDYVHRIGRTGRA

SEQ ID NO: 4 - protein, 29 aa, Artificial sequence
  MEME motif A + B + C
  VARIANT (1)..(1): / replace = "Asn"
  VARIANT (6)..(6): / replace = "Ser"
  VARIANT (7)..(7): / replace = "Phe"
  VARIANT (7)..(7): / replace = "Phe"
  VARIANT (25)..(25): / replace = "Val"
  VARIANT (29)..(29): / replace = "Leu"
SLRRVTYLVLDEADRMLDMGFEPQIRKIV

SEQ ID NO: 5 - protein, 29 aa, Artificial sequence
  MEME motif A + B + C
  VARIANT (2)..(2): / replace = "Ser"
  VARIANT (8)..(8): / replace = "Ser"
  VARIANT (9)..(9): / replace = "Ile"
  VARIANT (12)..(12): / replace = "Leu"
  VARIANT (13)..(13): / replace = "Met"
  VARIANT (19)..(19): / replace = "Val"
  VARIANT (20)..(20): / replace = "Ala"
  VARIANT (23)..(23): / replace = "Ala"
PTPIQAQAWPIALSGRDLIGIAKTGSGKT

SEQ ID NO: 6 - protein, 50 aa, Artificial sequence
  MEME motif A + B
  VARIANT (11)..(11): / replace = "Val"
  VARIANT (12)..(12): / replace = "Pro"
  VARIANT (14)..(14): / replace = "Ile"
  VARIANT (15)..(15): / replace = "Lys" / replace = "Arg"
  VARIANT (16)..(16): / replace = "Tyr"
  VARIANT (18)..(18): / replace = "Val"
  VARIANT (21)..(21): / replace = "Ser"
  VARIANT (24)..(24): / replace = "Thr"
  VARIANT (25)..(25): / replace = "Gly"
  VARIANT (26)..(26): / replace = "Leu" / replace = "Val"
  VARIANT (41)..(41): / replace = "Lys"
  VARIANT (42)..(42): / replace = "Thr"
  VARIANT (44)..(44): / replace = "Leu" / replace = "Thr"
  VARIANT (46)..(46): / replace = "Tyr"
ATDVAARGLDIKDVEVVINYDFPLTTEDYVHRIGRTGRAGAKGVAHTFFT

SEQ ID NO: 7 - protein, 50 aa, Artificial sequence
  MEME motif A + B
  VARIANT (1)..(1): / replace = "Ser"
  VARIANT (2)..(2): / replace = "Arg"
  VARIANT (4)..(4): / replace = "Ile" / replace = "Thr"
  VARIANT (5)..(5): / replace = "Ser"
  VARIANT (8)..(8): / replace = "Gln" / replace = "Glu"
  VARIANT (10)..(10): / replace = "Thr"
  VARIANT (11)..(11): / replace = "Phe"
  VARIANT (12)..(12): / replace = "Val"
  VARIANT (28)..(28): / replace = "Glu"
  VARIANT (29)..(29): / replace = "Val"
  VARIANT (31)..(31): / replace = "Ala"
  VARIANT (33)..(33): / replace = "Leu"
  VARIANT (34)..(34): / replace = "Gly"
  VARIANT (35)..(35): / replace = "Glu"
  VARIANT (36)..(36): / replace = "Ile"
  VARIANT (37)..(37): / replace = "Pro"
  VARIANT (38)..(38): / replace = "Ser"
  VARIANT (42)..(42): / replace = "Met"
  VARIANT (43)..(43): / replace = "Val"
  VARIANT (45)..(45): / replace = "Trp" / replace = "Tyr"
  VARIANT (46)..(46): / replace = "Thr"
MGVCNLRRVSYLVLDEADRMLDMGFEPQIRKIVSQTRPDRQTLMFSATWP

SEQ ID NO: 8 - protein, 44 aa, Artificial sequence
  MEME motif A + B
  VARIANT (4)..(4): / replace = "Lys"
  VARIANT (6)..(6): / replace = "Thr"
  VARIANT (10)..(10): / replace = "Ser"
  VARIANT (12)..(12): / replace = "Ala" / replace = "Gly"
  VARIANT (15)..(15): / replace = "Met" / replace = "Phe"
  VARIANT (16)..(16): / replace = "Leu"
  VARIANT (17)..(17): / replace = "Met"
  VARIANT (18)..(18): / replace = "Lys" / replace = "Gln"
  VARIANT (22)..(22): / replace = "Ile"
  VARIANT (23)..(23): / replace = "Val"
  VARIANT (24)..(24): / replace = "Ala"
  VARIANT (27)..(27): / replace = "Lys" / replace = "Glu"
  VARIANT (35)..(35): / replace = "Gly"
  VARIANT (36)..(36): / replace = "Tyr"
  VARIANT (37)..(37): / replace = "Gly"
  VARIANT (38)..(38): / replace = "Ile"
  VARIANT (40)..(40): / replace = "Gly"
  VARIANT (41)..(41): / replace = "Phe" / replace = "Ile"
  VARIANT (42)..(42): / replace = "Val"
  VARIANT (44)..(44): / replace = "Ile / replace = "Leu"
GFSEPSPIQAQSWPIALDGRDLIGIAATGSGKTLAFLLPALMHV

SEQ ID NO: 9 - protein, 50 aa, Artificial sequence
  MEME motif A
  VARIANT (1)..(1): / replace = "Val"
  VARIANT (7)..(7): / replace = "Ser"
  VARIANT (17)..(17): / replace = "Tyr"
  VARIANT (22)..(22): / replace = "Thr"
  VARIANT (43)..(43): / replace = "Thr"
  VARIANT (45)..(45): / replace = "Leu"
IATDVAARGLDIPDVEVVINYSFPLTTEDYVHRIGRTGRAGKKGVAHTFF

SEQ ID NO: 10 - protein, 50 aa, Artificial sequence
  MEME motif A
  VARIANT (11)..(11): / replace = "Leu"
  VARIANT (17)..(17): / replace = "Ile"
  VARIANT (19)..(19): / replace = "Ser"
  VARIANT (21)..(21): / replace = "Ala"
  VARIANT (22)..(22): / replace = "Ser"
  VARIANT (25)..(25): / replace = "Arg"
  VARIANT (26)..(26): / replace = "Ala"
  VARIANT (27)..(27): / replace = "Val"
  VARIANT (30)..(30): / replace = "Thr"
  VARIANT (40)..(40): / replace = "Ser"
  VARIANT (42)..(42): / replace = "Gln"
  VARIANT (43)..(43): / replace = "Gln"
VLDEADRMLDMGFEPEVRAILGQTCSDRQMVMFSATWPLAVHKLAQEFMD

SEQ ID NO: 11 - protein, 50 aa, Artificial sequence
  MEME motif A
  VARIANT (3)..(3): / replace = "Glu"
  VARIANT (5)..(5): / replace = "Thr"
  VARIANT (9)..(9): / replace = "Gln"
  VARIANT (10)..(10): / replace = "Arg"
  VARIANT (16)..(16): / replace = "Ser"
  VARIANT (17)..(17): / replace = "Gln"
  VARIANT (21)..(21): / replace = "Ile"
  VARIANT (24)..(24): / replace = "Ser"
  VARIANT (28)..(28): / replace = "Leu"
  VARIANT (29)..(29): / replace = "Val"
  VARIANT (40)..(40): / replace = "Ile"
  VARIANT (44)..(44): / replace = "Ile"
  VARIANT (50)..(50): / replace = "Ile"
VLDCCKGFEKPSPIQAHAWPFLLDGRDFIGIAATGSGKTLAFGVPALMHV

SEQ ID NO: 12 - DNA, 1434 bp, Glycine max
atgggtcggaaacacgacgccgttttggtcagcgaaccagtcgccgaagaagttccctacagccccgagctcgattccgagaagaagaagaagaagaaaaaaaggaagaacaagaacaaagacaagcaccaaactgatagcagcaccaaacgaaagctcgacgaacaactcgaccctcaaaacggcaccgaatcgaataagaagaaaaagaagcaccacgagtccaaagagaacgccgaggaaaccaacggcaacaacaacagtgacaacggtgctaatcgcgacgaaacggtggcggacgggtccgtggtggtcaccgggttgaatgcgggagacgcgaaatatgcggcggtgaagagcttcgcggattcggggctgccggagaacgtgctggagtgctgcaagggtttccagaagccttctccgattcagtcccgagcctggcctttcttattggacggtcgtgatttgattggaattgctgccactggctcagggaagacgttggcgttcggcttaccggcggttatgcatgttttggggaagcggaaggggaaaagttccaagggacgaaaccctctcggcctcgtgctatctcccactagagagctagctcaacagatatcagatgtcatgtgtgatgctggtaggtcttgtggtgtgcaatcaatctgtttgtatggtggaacctctaaagggccacaaatctcctcactaaaatctggcattgacattgtcattggaacccctggtcgtatccaggatctgattgaaatgggtatctgttgcctaaaagaagtatcttttgtggtacttgatgaagctgatcggatgcttgacatgggttttgaacaaatagttcgctctatactgggtcaaacgtgttctgatcgtcaaatggttatgttcagtgctacatggcctttgccagttcattacttggcacaggagtttatggatcctaatcctgtaaaagttgttgtaggctcagaagacttagctgccaatcatgatgtcatgcagatagttgaggtcttggatgatcgttctcgtgataagcgcctagctgctttactggaaaagtaccacaaatctcagaggaatcgagtattggtttttgttttgtacaaattggaagccaaacgagttgaaaatatgcttcaagaagggggttggaaggttgtatcaatacacggggacaaagcccaacatgatcgcacaaaagcactctcattgttcaagaatggaagctgtcctttgatgattgctactgatgtggccgcacgaggattggatattccagatgttgaagtagtgatcaactatagttttcctctgactacagaagattatgttcatagaattgggcgtactggacgagctggtaaaaattctttatgcagcagaataagggacttgctggggagttggtga

SEQ ID NO: 13 - protein, 477 aa, Glycine max
MGRKHDAVLVSEPVAEEVPYSPELDSEKKKKKKKRKNKNKDKHQTDSSTKRKLDEQLDPQNGTESNKKKKKHHESKENAEETNGNNNSDNGANRDETVADGSVVVTGLNAGDAKYAAVKSFADSGLPENVLECCKGFQKPSPIQSRAWPFLLDGRDLIGIAATGSGKTLAFGLPAVMHVLGKRKGKSSKGRNPLGLVLSPTRELAQQISDVMCDAGRSCGVQSICLYGGTSKGPQISSLKSGIDIVIGTPGRIQDLIEMGICCLKEVSFVVLDEADRMLDMGFEQIVRSILGQTCSDRQMVMFSATWPLPVHYLAQEFMDPNPVKVVVGSEDLAANHDVMQIVEVLDDRSRDKRLAALLEKYHKSQRNRVLVFVLYKLEAKRVENMLQEGGWKVVSIHGDKAQHDRTKALSLFKNGSCPLMIATDVAARGLDIPDVEVVINYSFPLTTEDYVHRIGRTGRAGKNSLCSRIRDLLGSW

SEQ ID NO: 14 - DNA, 1521 bp, Zea mays
atgggccgcaatcttccagccgagcaagtggaagcacccaggagcagcaagatggacaagaagagaaagaaggacaagaagcggaagctggcagccgaggccgaggaggaggcggcggtgacggcgacagtggagaccgtgaagagcagcaagaagaagcgggtggagaatgaacccggcgcaggagcagtggaggcggagaacggcgctgagaagaccgtggcggtgaccgggaagggttcggaggaccctaagtacgcgccgctacggtcgttctccgctgccgagctgccgtctcaggtgctcgaatgctgcagcgcgttcgcgcggccgtcacctatccaggcacacgcctggccgttcctcctcgacggccgggacttcatcggcatcgccgccaccggatccggaaagacaatcgcctttggcgtgccggcgctgatgcacatcaggaagaaggtaggggggaaagcagggaagaaggccgtgccacggtgcctcgtgctatcaccaacgagggagctcgctcagcagatttcagatgtacttagtgaggctggtgcaccatgtgggataaaatcagtctgtctttatggtggaactaaaaaggaaccccaaatatctgcccttaaatctggagtggatatagtcataggaactcctggtcgtatgaaagaccttattgaaatgggtgtttgctgtcttaatgaggtttcgtttgtggttctagatgaagcagataggatgctggatttgggtttcgaacctgaagtcagggcaattttgagccaaacatcatctgtacgccagatggttatgttcagtgcaacatggcctcttgctgtccacaaattagcccaggagtttatggatccaaatccgataaaggttgttattggatcagaagaccttgctgctaaccatgacgtgatgcaaattgttgaagtattggatgatagaacaagggattcaagattacttgccttgcttgacaaataccatcaagcacaaagggttttggtttttgtgctgtacaagaaagaagctgcacgagtggaaacaatgcttcagagaaggggatggaaggctgtttcagtccatggcgacaaggctcagcatgatagaacaaaagctttatctttatttaaagaagggaaatgcccattaatgattgctacagatgtcgcttcacgtggacttgatattcctgatgttgaagtagtgattaactatagttaccctttgaccactgaggactacgtccacaggataggaaggactggtcgtgctggcaagaaaggtgttgcacatacctttttcactcaagctaacaaggcacttgctggtgaacttgtgaatgttctgcgggaggctgatcaggttgttcctccagcccttatgaaatttggcacacatgtcaagaaaaaggaatctaagatatacggatctcatttcaaggaaattacagcagatgctcctaaatctacgaagatcacatttggcgattccgatgaggactga

SEQ ID NO: 15 - protein, 506 aa, Zea mays
MGRNLPAEQVEAPRSSKMDKKRKKDKKRKLAAEAEEEAAVTATVETVKSSKKKRVENEPGAGAVEAENGAEKTVAVTGKGSEDPKYAPLRSFSAAELPSQVLECCSAFARPSPIQAHAWPFLLDGRDFIGIAATGSGKTIAFGVPALMHIRKKVGGKAGKKAVPRCLVLSPTRELAQQISDVLSEAGAPCGIKSVCLYGGTKKEPQISALKSGVDIVIGTPGRMKDLIEMGVCCLNEVSFVVLDEADRMLDLGFEPEVRAILSQTSSVRQMVMFSATWPLAVHKLAQEFMDPNPIKVVIGSEDLAANHDVMQIVEVLDDRTRDSRLLALLDKYHQAQRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKESKIYGSHFKEITADAPKSTKITFGDSDED

SEQ ID NO: 16 - DNA, 1614 bp, Arabidopsis thaliana
atggctggacaaaagcaagagcttcccgtctccggcgaacctttagccgtcgagagtccgatgaccaacaagaagaagaagaaaagcaagaagaacaaacatacagaggaaaatcatgaagtcgaagaagtgcctcaagaggtcactaatggtgtagaggaagagttgagtaataaagagaagaagaagaaacgtaagagagaggagaaagagtctgagaagaataagaagaaggatgtcccggagaagaagcttgaagctgaggatttaggagaaggagagagtgaacaacagaaggttgttgtgactgggaaaggtgtggaagaagcaaagtacgcagctttgaagacttttgctgaatcgaatttgccggagaatgttttagattgttgtaagactttcgagaagccgtctccgattcagtcacatacgtggccgtttttgttagatgggcgtgatcttatcgggattgcgaaaactgggtcaggtaagacattggcttttgggattcctgcgattatgcatgtgttgaagaaaaataagaagattggtggaggatcaaagaaggttaatcctacttgtttagttctttctcctacacgagaattggctgttcagatttctgatgttttgcgtgaagctggagaaccgtgtggtttgaaatcgatttgtgtgtatggtggaagctctaaagggcctcaaataagtgcaattcgatctggagttgatattgtcattggtacgcctggtcgtttgagagacttgattgagtctaatgtgcttcgtctctcggatgtttcctttgtcgtattggatgaagcagatcgaatgcttgatatgggtttcgaggaacctgtccggtttatattgagtaacacaaataaagttcgtcaaatggttatgttcagtgcaacttggcctttggatgttcacaaattggcccaggaattcatggatccaaatccaatcaaggtgatcataggttctgtagacttagctgccaaccacgacgttatgcaaatcattgaggtcttggatgaacgtgcgcgtgatcagcgtctcattgcattactagaaaaataccataaatctcaaaagaacagggttttggtatttgctttatacaaggtggaagctgaacgtctcgagcgttttcttcagcaaagaggttggaaagctgtatctatacacggaaacaaagcacagagcgaacgtaccaggtctttatcattgttcaaagaaggatcctgcccgttactggtggctactgatgttgcagcaagagggcttgatatcccggacgtggaagttgtgataaactacactttccctttaacaacagaggattatgtacacagaatcgggaggacaggaagagcgggtaaaaagggcgttgcacacaccttcttcacgccactgaacaagggtcttgcaggagaacttgtgaatgttcttagggaagcaggacaagtagtgccagctgatcttttgaagtttggcactcatgtaaagaaaaaggaatcaaaattgtatggagctcatttcaaagaaatagctgctgatgctcctaaagctacgaagatcacattcgataattctgatgacgaagactag

SEQ ID NO: 17 - protein, 537 aa, Arabidopsis thaliana
MAGQKQELPVSGEPLAVESPMTNKKKKKSKKNKHTEENHEVEEVPQEVTNGVEEELSNKEKKKKRKREEKESEKNKKKDVPEKKLEAEDLGEGESEQQKVVVTGKGVEEAKYAALKTFAESNLPENVLDCCKTFEKPSPIQSHTWPFLLDGRDLIGIAKTGSGKTLAFGIPAIMHVLKKNKKIGGGSKKVNPTCLVLSPTRELAVQISDVLREAGEPCGLKSICVYGGSSKGPQISAIRSGVDIVIGTPGRLRDLIESNVLRLSDVSFVVLDEADRMLDMGFEEPVRFILSNTNKVRQMVMFSATWPLDVHKLAQEFMDPNPIKVIIGSVDLAANHDVMQIIEVLDERARDQRLIALLEKYHKSQKNRVLVFALYKVEAERLERFLQQRGWKAVSIHGNKAQSERTRSLSLFKEGSCPLLVATDVAARGLDIPDVEVVINYTFPLTTEDYVHRIGRTGRAGKKGVAHTFFTPLNKGLAGELVNVLREAGQVVPADLLKFGTHVKKKESKLYGAHFKEIAADAPKATKITFDNSDDED

SEQ ID NO: 18 - DNA, 1578 bp, Aquilegia sp.
atgggaaagaaactcgaagcagtcgcgcagtacggagaaccagaagaaaccctagatttccataaaaagaagaagaagaagaataagaacaagaagaacgaagaagctaacaatttgaagagaaagctagaacaagaagaaaatgaaattgtagaatctaataataataataataagaagaagaaaaacaaaaagaagaattctgaagaaagtgttggagtgttagaagaagaggggaagaagcaggaaagtgagaatgatggaaaagaagtgtttgtgtctggaaataacattaatgaatcaaagtacaaagcgttaagctcgtttgaggaagctaagctaccagatgaagtacttcagtgttgcaagagttttagtaaaccatctccaattcaatctcatgcttggccatatcttcttgatggacgcgattttattggtattgctgctactggatctggcaaaacattggcatttgggattccagctctcatgcatatacgacatagcgtgaaccaaaaaacgaccaggagagtaaatcctctttgccttgtcctctcaccgacaagggaattagctcaacaaattgcagatgttctctgcgaagcaggaaagtcctgtggtgcgagatcagtttgtttgtatggaggaacatccaaaggacctcaaatatccgctttgaaggctggagtggatattgtcattggaacacctggccgtttgaaagatctgatggagatgggtttttgccgcttacaggaggtatcatatgtggttctggacgaagcagaccgaatgcttgacatgggatttgaaccagaagtccgttcaatattgagccagacatgctctgtccgccagatggtaatgttcagtgcaacatggccttcttctgttcatcagttagctcaagagtttatggatccaaatcctgttaaggttgttgtgggttcagaggatttggctgctaaccatgacgttatgcagatagtagaggtcttggatgatagagctcgtgatgcacgtttgattgccttgctagaaaaataccacaaatcgcaaaagaatagagtattggtatttgttttgtacaagaaagaagcagctcgtgttgaaaatatgctccaaagaagcggttttaaggctgtgtctgtgcatggagacaaagctcaaagggatcgtacaaatgcacttggattattcaaggaaggaacatgccctttaatggttgctactgatgtagctgctcgaggattggatattcctgatgtggaagtggtgatcaactacagcttccctctcacaactgaagattatgtgcacaggatagggagaactggtcgagccggtaagaagggggttgcacacaccttttttatgcaggaaaataagggcctcgctggggagcttgtgaatgtgctcagagaagctgggcagattgtgcccactgaccttacaaagtttggaacccatgtgaagaaaaaggaatcaaagctatatggagcccactttaaagaaatttctgttgatgctccgaagtctaaaaaaatcaccttcgataattccgacgaagattag

SEQ ID NO: 19 - protein, 525 aa, Aquilegia sp.
MGKKLEAVAQYGEPEETLDFHKKKKKKNKNKKNEEANNLKRKLEQEENEIVESNNNNNKKKKNKKKNSEESVGVLEEEGKKQESENDGKEVFVSGNNINESKYKALSSFEEAKLPDEVLQCCKSFSKPSPIQSHAWPYLLDGRDFIGIAATGSGKTLAFGIPALMHIRHSVNQKTTRRVNPLCLVLSPTRELAQQIADVLCEAGKSCGARSVCLYGGTSKGPQISALKAGVDIVIGTPGRLKDLMEMGFCRLQEVSYVVLDEADRMLDMGFEPEVRSILSQTCSVRQMVMFSATWPSSVHQLAQEFMDPNPVKVVVGSEDLAANHDVMQIVEVLDDRARDARLIALLEKYHKSQKNRVLVFVLYKKEAARVENMLQRSGFKAVSVHGDKAQRDRTNALGLFKEGTCPLMVATDVAARGLDIPDVEVVINYSFPLTTEDYVHRIGRTGRAGKKGVAHTFFMQENKGLAGELVNVLREAGQIVPTDLTKFGTHVKKKESKLYGAHFKEISVDAPKSKKITFDNSDED

SEQ ID NO: 20 - DNA, 1266 bp, Chlorella sp.
atgcccacccccgtgcctccctgctccacaggcctgtctgccgccgagctgcacgccacccgcagcttccagcacccctcccccatccaggcacagtgcctgccgctggcgctcagcggccgtgacttggtcggcatcgcggccacagggtctggcaagacgctggcctttgggctgcccgcgctgcgccacatccgcgcgcagagcgaggcgggcgtcgccacgggcaagaagcctgtggcactggtgattgcccccacccgggagctggccctacagatctgcgcggtgctggaggaggcgggcagccagtgcggcatcagcacggtgtgcgtgtatggcggcgttcccaagcgggagcaggtggctgcgctgcgcaagggcgccgccatcgtggtggccacgccggggcgcctggaggacctgctggaggatggggcctgcaggctggacgaggtgtcctacctggtgctggacgaggcagaccgcatgctggacctgggctttgagccgcacatacgcgccattgccggcaagacgcgcgccgaccgccagacactcatgttctcggccacctggccgcccgccatccgcaagctggcctctgagttcctctgccaccccgtgagggtcaccatcggctcccaggacctggccgcctcccactcagtcacccaggtgattgaggtgattgaggaccgggcgcgggacgggcggctgcacgagctgctgcagcggtaccacgcgtcccgctccaatcgcgtcatcatcttcgtgctgtacaagaaggaggcggtacgggtggagcagctgctgcagcgcaagggctggaaggcggccgcgatccacggcgacatctcccaggtgcagcgcagctcggcggtggagcagttcaagagcggcgcagtgccgctgctggtggccacagacgtggcagcgcgcgggctggacatacccgacgtcgaggcagtactcaactactccttcccactcacaacagaggactacgtgcaccgcatcgggcgcacggggcgcgccggcaagacgggcaaggcccacactttctttgtgggcaacaacgacaagccgcgggcgggcgagctcatcaatgtgctgcgggaggccaagcagacggtaccagaggaactcctgaagtttggcactacggtcaagaagaaggagagcaagctgtacggcgcgcacttcaaggatgtggaccactcgcagaaagccacaaagatcagcttcgacagcgacgacgagtga

SEQ ID NO: 21 - protein, 421 aa, Chlorella sp.
MPTPVPPCSTGLSAAELHATRSFQHPSPIQAQCLPLALSGRDLVGIAATGSGKTLAFGLPALRHIRAQSEAGVATGKKPVALVIAPTRELALQICAVLEEAGSQCGISTVCVYGGVPKREQVAALRKGAAIVVATPGRLEDLLEDGACRLDEVSYLVLDEADRMLDLGFEPHIRAIAGKTRADRQTLMFSATWPPAIRKLASEFLCHPVRVTIGSQDLAASHSVTQVIEVIEDRARDGRLHELLQRYHASRSNRVIIFVLYKKEAVRVEQLLQRKGWKAAAIHGDISQVQRSSAVEQFKSGAVPLLVATDVAARGLDIPDVEAVLNYSFPLTTEDYVHRIGRTGRAGKTGKAHTFFVGNNDKPRAGELINVLREAKQTVPEELLKFGTTVKKKESKLYGAHFKDVDHSQKATKISFDSDDE

SEQ ID NO: 22 - DNA, 1614 bp, Glycine max
atgggtcggaaacacgacgccgttttggccagcgaacctgtcgccgaagaagccccctgcagccctgagctcgattccgagaagaagaagaagaagaaaaagaagaacaaaaacaaagacaagcaccaaaccgaaagcagccccaaacgaaagctcgacgaacacgacccccaaaacggcaccgaatcgaagaagaaaaagaagaagcaccacgagtccaaggggaacgccgaggaaaccaacggcgatagcaacaacaacaacggcgatggtgctaatcgcgaggaaacggcgacggatgggtctgttgtggtcaccggtaacaatgcgggagaggcgaaatacgccgcggtgaagagcttcgcggattcggggctgccggagaacgtgctggagtgctgcaagggtttcgagaagccttctccgattcagtcccgggcgtggcctttcttattggacggtcgtgatttgattggaattgctgccactggctcagggaagacgttggcgttcggcataccggcggttatgcatgttttggggaagcggaaggggaaaagttccaagggacgaaaccctctcggcctcgtgctctcacccactagagagctagctcaacagatatcagatgtcatgtgtgatgctggtaggtcttgtggtgtgcaatcaatctgtttgtatggtggaacctccaaagggccacaaatctcctcactaaaatctggcattgacattgtcattggaacccctggtcgtatccaggatctgattgaaatgggtatctgttgcctaaaagaagtatcttttgtggtacttgatgaagctgatcggatgcttgacatgggttttgaacaaatagttcgctctatactgggtcaaacgtgttctgatcgtcaaatggttatgttcagtgctacatggcctttgccagttcattacttggcacaggagtttatggatcctaatcctgtaaaagttgttgtaggctcagaagacttagctgccaatcatgatgtcatgcagatagttgaggtcttggatgaccgttctcgtgataagcgcctagttgctttactggaaaagtaccacaaatctcagaggaatcgagtattggtttttgttttgtacaaattggaagccaaacgagttgaaaatatgcttcaagaagggggttggaaggttgtatcaatacacggggacaaagcccaacatgatcgcacaaaggcactctcattgttcaagaatgcaagctgtcctttgatgattgctactgatgtggccgcacgaggattggatattccagatgttgaagtagtgataaactatagttttcctctgactacagaagattatgttcatagaattgggcgaactggacgagctggtaaaaaaggtgttgcccatacattctttatgcagcagaataagggacttgctggggagctggtgaatgttttaagagaagcagggcaaattgtaccggatgccctcctgaaatttggcacacatgtaaagaaaaaggagtccaaactttatggggcacacttcaaggaaattcctgttgatgctccaaagtctcaaaagaaaacatttgacgactctgatgaagactaa

SEQ ID NO: 23 - protein, 537 aa, Glycine max
MGRKHDAVLASEPVAEEAPCSPELDSEKKKKKKKKNKNKDKHQTESSPKRKLDEHDPQNGTESKKKKKKHHESKGNAEETNGDSNNNNGDGANREETATDGSVVVTGNNAGEAKYAAVKSFADSGLPENVLECCKGFEKPSPIQSRAWPFLLDGRDLIGIAATGSGKTLAFGIPAVMHVLGKRKGKSSKGRNPLGLVLSPTRELAQQISDVMCDAGRSCGVQSICLYGGTSKGPQISSLKSGIDIVIGTPGRIQDLIEMGICCLKEVSFVVLDEADRMLDMGFEQIVRSILGQTCSDRQMVMFSATWPLPVHYLAQEFMDPNPVKVVVGSEDLAANHDVMQIVEVLDDRSRDKRLVALLEKYHKSQRNRVLVFVLYKLEAKRVENMLQEGGWKVVSIHGDKAQHDRTKALSLFKNASCPLMIATDVAARGLDIPDVEVVINYSFPLTTEDYVHRIGRTGRAGKKGVAHTFFMQQNKGLAGELVNVLREAGQIVPDALLKFGTHVKKKESKLYGAHFKEIPVDAPKSQKKTFDDSDED

SEQ ID NO: 24 - DNA, 1695 bp, Gossypium raimondii
atgcctccatcgatagaacaactgaccccagagactacgagcaatccagcattcaacgccaagaaacaggacaagaagaagaagaagaagaacaaattaccaaaagcggaagatcaaattgaagaaaatgttaagcagagtcaccaagagaacgaggaaattcaactaaaaaagagcaagaaagacaagaaaaagcgaaagaaagaaaaggaaaacaacgaaggtgaatccgaggaagtgaatcacgatgaaagcggtgaggagtctaagaaggaaaataagaagaagacgctcaaaaagcagaagaaagaggaagaaaatggggattctattgaaactgcaaatggtaaagaagactcggttcaatttgatgacaaggagaaggtggtagtgagtggaaaaaacgctgaagaagcgaaatatgcgccgttgaaatcattttctaattctaagttaccaaaaaatgttttggattgctgcaagggtttttctagcccatctcctattcaagctcacgcctggccctttttattggatggtcgtgattttattggaattgcaaaaactggatcaggcaagactttggcatttggcgtaccggcaatgatgcttgtattgaaccagcgaaatggtaaatcctcaaaagggaagaatccgctttgcctcgtactttctcctacaagagagttggctgaacaaatatttaacgttttgtgtaatgctgggcaagcttgtgatgtcaaatccgtttgtttgtatggaggaacagctaaaggacctcagatttcttctttaaagtctggtgttgatattgttattggaacacctggtcgtttgaaggatttgatgaatatggaggtgtgtcagctcaatgaggtatcttttgtggttctagatgaagctgatcgaatgcttgacatgggatttgaagaggatgttcgctttatattgggaaagacttgttctgctcgtcagatggtaatgttcagtgctacatggcctgcagcggttcatcggttagctcaggagtacatggaccctaatcctgttaaggttgtgattggctcagaagatttagctgccaaccatgatgttatgcagatagttgaggttttagatgatcgtgcacgttatgagcgattgactgctttgctcaagaaataccatgaatctcagaggaatagagtgttggtatttgtcttgtaccaggcagaagctgatcgaattgaaaatatgcttaagagaagtggctggaatgttgtttctatacatggtcgcaaagcgcaaaatgaacgcactaaggcactatcattatttaagaaaggaagctgtcctttgatggtagctacagatgtggctgctagaggattggatattccagatgttgaagtagtgatcaattatagttttcctctcgctacagaggattatgtaccccggatagggaggactggaagagctggtaggaagggtgttgctcacccattctttacacagcaaaataagggacttgctggagaactggtaaatgttttaaaagaagctgggcaggttgtcccccctgcattattgaaatttggaactcatgtaaagaaaaaggagtccaagctatatggggctcacttcaaggaaatagctgctgatgctccaaaggctaaaaaaataacatttgatgactcggatgatgaaaactga

SEQ ID NO: 25 - protein, 564 aa, Gossypium raimondii
MPPSIEQLTPETTSNPAFNAKKQDKKKKKKNKLPKAEDQIEENVKQSHQENEEIQLKKSKKDKKKRKKEKENNEGESEEVNHDESGEESKKENKKKTLKKQKKEEENGDSIETANGKEDSVQFDDKEKVVVSGKNAEEAKYAPLKSFSNSKLPKNVLDCCKGFSSPSPIQAHAWPFLLDGRDFIGIAKTGSGKTLAFGVPAMMLVLNQRNGKSSKGKNPLCLVLSPTRELAEQIFNVLCNAGQACDVKSVCLYGGTAKGPQISSLKSGVDIVIGTPGRLKDLMNMEVCQLNEVSFVVLDEADRMLDMGFEEDVRFILGKTCSARQMVMFSATWPAAVHRLAQEYMDPNPVKVVIGSEDLAANHDVMQIVEVLDDRARYERLTALLKKYHESQRNRVLVFVLYQAEADRIENMLKRSGWNVVSIHGRKAQNERTKALSLFKKGSCPLMVATDVAARGLDIPDVEVVINYSFPLATEDYVPRIGRTGRAGRKGVAHPFFTQQNKGLAGELVNVLKEAGQVVPPALLKFGTHVKKKESKLYGAHFKEIAADAPKAKKITFDDSDDEN

SEQ ID NO: 26 - DNA, 1593 bp, Hordeum vulgare
atggaccccgaactcctctctatgcaggaggaactatcaaacgatagaaagaaggatacaaagagcaagaaggcgaagaagccgaagccagcggccgacgaggcagcggcggaagaggatgacctatccaacaagagaaagaaggataaaaagagcaagaaggacaagaagcggaagctagcggcagagaacgaggaggcagcgacggaagaagagggcaagagcagcaagaagagaggggtgaccaaagaggaaccggaccaagtaggggccgtcgagaagagcgtggcggtgactgggaaggggttcgccgaccccaagtatgcgccgctcaagtccttcgccgccgcggcgctgccaacccaggtgctcgactgctgcaaggggttcgaccggccgtcgcccatccaggcgctagcctggccgtatctcctcgatggccgcgatttcattggcatcgctgccaccggatctgggaagactattgcgtttggtgtgccggcgctgatgcacgtcaggaagaagctgagtgaaaaaggcgccaagaaggggttgccgcgatgcctcatgctggctccaacgagggagcttgctcagcagatcgcagatgtacttactgaagctggtgcgccatgcgggataaattcagtgtgcctctatggtggaacatcaaagggaccccaaatatcttcccttaaatctggagttgaaatagtcataggaactcctggtcgtatgaaagacctcattgaaatgggtgtttgtcgtcttaacgaggtttcttttgtggttcttgatgaagcagatcgcatgctggatatgggttttgagcccgaggtcagggcgattttaagccaaacatcatcggtgcgtcagatggttatgttcagtgcaacatggccttttgctgtccaccagctagcccaagagtttatggatccgaatccaataaaggttgttgttggatcggaagatcttgcagctaaccatgatgtgatgcaaattgttgaagtattggatgatagagcacgggattcaagattggttgctttgcttgacaagtatcatcgagcacagagcaaccgcgttttagtttttgtgttgtacaagaaagaagcagggcgagtagaagcaatgcttaataaaagggggtggaaagctgtttctgttcatggagacaaggctcagcatgatagaacaaaagccttatcattatttaaagaaggaaaatgtcctttaatgattgcgacggatgtggcttcacgcggacttgatattcctgatgttgaagttgtcatcaattatagttttcctttgaccacggaggattatgtacacaggattgggaggacaggtcgtgcaggcaagaaaggtgttgcacatacattcttcactcaagcggacaagggacttgctggtgagcttgtcaatgttttacgggaggctgatcaggttgttcctccagcccttacgaaatttggcacacatgtgaagaaaaaggaatcaaagatctatggttcccacttcaaggaaatcacagccgatgctcctaaatcaacaaagatcacattcggtgattcggacgaggagtaa

SEQ ID NO: 27 - protein, 530 aa, Hordeum vulgare
MDPELLSMQEELSNDRKKDTKSKKAKKPKPAADEAAAEEDDLSNKRKKDKKSKKDKKRKLAAENEEAATEEEGKSSKKRGVTKEEPDQVGAVEKSVAVTGKGFADPKYAPLKSFAAAALPTQVLDCCKGFDRPSPIQALAWPYLLDGRDFIGIAATGSGKTIAFGVPALMHVRKKLSEKGAKKGLPRCLMLAPTRELAQQIADVLTEAGAPCGINSVCLYGGTSKGPQISSLKSGVEIVIGTPGRMKDLIEMGVCRLNEVSFVVLDEADRMLDMGFEPEVRAILSQTSSVRQMVMFSATWPFAVHQLAQEFMDPNPIKVVVGSEDLAANHDVMQIVEVLDDRARDSRLVALLDKYHRAQSNRVLVFVLYKKEAGRVEAMLNKRGWKAVSVHGDKAQHDRTKALSLFKEGKCPLMIATDVASRGLDIPDVEVVINYSFPLTTEDYVHRIGRTGRAGKKGVAHTFFTQADKGLAGELVNVLREADQVVPPALTKFGTHVKKKESKIYGSHFKEITADAPKSTKITFGDSDEE

SEQ ID NO: 28 - DNA, 1572 bp, Medicago truncatula
atggctcgcaaaaacgacgccgttttatccaccgaaccagaacaagcccttaacaacaacaccgaactcaaatcctccaagaagaagaccaaaaagaacaaacacgaagaaaccactcccaaaagaaagcaccaagacgaaaccaatcttcaaaacgacaccgaatcagagaagaaaagtaagaagaagaaaaagcataacaaatcagaggaaaataacgacgctggtggtgtgtcggtttctgcgtcggatgaaccgattgtggtgacagggaagaatgccggagatgagaaatacacgccggttaagaggtttgaggattcggggctaccggagaatgtgcttgagtgttgtaagggttttgagaaaccttctccgattcaatcacgtgcttggccgtttttgttggatggtcgtgatttgattggaattgcggctactgggtcagggaagacacttgcttttggaataccagctattatgcatgttatgaataagcggaagagtaagggttcgtccaagggtcggaatcctctttgccttatgctctctcctacgagagagctagctcaacaaatatcagatgtattgtgtgatgctggtaaatcttgtggcgtggaatcagtttgtttgtatggtggaacccccaaaggagcacaaatctctgcactaaaatctggcattgatattgtcattggaacccccggtcgtattcaagatctggttgaaatgggtatctgtcgcctacaagaagtatcttttgtggtccttgatgaagcagatcggatgcttgacatgggttttgaacaaatagtccgttctatacttggtcagacatgttctgctcgtcaaatggttatgttcagtgccacatggccgttagcagttcatcacttggctcaggaatttatggatcccaaccctgtaaaagttgttgtaggctcagaggatttatctgccaatcatgatgtcatgcaaatagttgaggtattggatgagcgtttacgtgataagcgcctgcttgctttactagaaaaataccacaaatctcaaaagaatcgagtacttgtttttgttttgtacaaatgggaaaccacacgggtggagaaaatgcttcaacaagggggttggaaagcagtgtcaataagtggtgacaaatcacagcatgagcgcacaaaggcactatcattattcaagaatggaagctgtcctttgatgattgctactgatgtggcggcacgaggattagatattccagatgttgaagtagtgatcaactttagttttcctctaactctagaagattatgttcatagaattgggcggactggacgagctggtaagaaaggtgttgcccatacattcttcacacatctgaataagggacttgctggggagcttgtgaacgttttgagagaagcaggacaagttgttccagacgatcttttgaaatttggcacacatgttaagaaaaaggagtccaagctttatggggctcacttcaaggaaattcctgttgatgctccaaagtctaaaaaaataacatttgacaactctgacgatgaagactaa

SEQ ID NO: 29 - protein, 523 aa, Medicago truncatula
MARKNDAVLSTEPEQALNNNTELKSSKKKTKKNKHEETTPKRKHQDETNLQNDTESEKKSKKKKKHNKSEENNDAGGVSVSASDEPIVVTGKNAGDEKYTPVKRFEDSGLPENVLECCKGFEKPSPIQSRAWPFLLDGRDLIGIAATGSGKTLAFGIPAIMHVMNKRKSKGSSKGRNPLCLMLSPTRELAQQISDVLCDAGKSCGVESVCLYGGTPKGAQISALKSGIDIVIGTPGRIQDLVEMGICRLQEVSFVVLDEADRMLDMGFEQIVRSILGQTCSARQMVMFSATWPLAVHHLAQEFMDPNPVKVVVGSEDLSANHDVMQIVEVLDERLRDKRLLALLEKYHKSQKNRVLVFVLYKWETTRVEKMLQQGGWKAVSISGDKSQHERTKALSLFKNGSCPLMIATDVAARGLDIPDVEVVINFSFPLTLEDYVHRIGRTGRAGKKGVAHTFFTHLNKGLAGELVNVLREAGQVVPDDLLKFGTHVKKKESKLYGAHFKEIPVDAPKSKKITFDNSDDED

SEQ ID NO: 30 - DNA, 1323 bp, Ostreococcus lucimarinus
atgtcggcgagcgaggtgcaggcggcgcgagacgcgttggcggtgacgcaggtggacggtttgtcgacggatttagcgccggtgtcttcattcgcagatgcggggttttcgaaggagctgctgcgagtgacggcacagtttaagacgccgtcaccgattcaagcgcaatcttggccgatcatcatgagcgggcacgacatggtggggatcgcggcgacgggttccgggaagacgctcgcgtttgggatgccggcgctgacgcagattcactcgcaaccaccctgcaagcccggtcagccgatctgtttagtgctcgcaccgacgcgagaattggcgcaacaaacggccaaggtgtttgacgacgccggcgaggcttctggggtgaggtgcgtatgcgtgtacgggggcgctcccaagtacgaacaaaaggcacagatgaaggcgggcggcggagccgcggtcatcgtcgcgacaccgggtcgtcttcgagatttcatggaagagggcgtgattaaacttgatagagtgacgatgttagtgctcgatgaggccgatcgcatgctggatttgggttttgagcctgaaattcgcgccatcgccggcgccacgcgcgccgatcgacaaaccgtgatgttttctgcgacgtggcctcagagtgtgcaaagcctcgcttcggagtttatgtgcaatcctatcaaggttcgcatcggtgccgaaggtttgaaagcttctcaaagcataactcaaatcgtcgaagtcgtcgagccgcaggacaaggatagacatttggcgcgagtcatgaagcaatatttgggcaaaggcaaagaggtgcctcgaaccctcattttcggtttgtacaagaaagagtgcgcaaatttgcaccaaagacttagccgtgaatggccagcagtgtgtattcacggcgacatgtctcagcatgatcgtgaaaagtcggtcgatgcgttcaagaaaggcacgtctcgaatcttgattgccaccgacgtcgccgcccgaggtctcgacattaaagaggtggagtatgtcatcaattatacgtttcctctcaccacggaggactatgttcacagaatcggtcgtaccggtcgcgctggtgcaacgggcttggctcacacattttttacattgcacgacaaggcgagagcgggcgaactcgtcaacgtgttacgaaaagctggcgcagaagttccagaagaactcactaagttcggcacgcacgtgaagaagaaagaaagtaagttgtatggcgcgcatttcaaggacgtggacatgtcggtgaaggctacgaagatcacgttcgattaa

SEQ ID NO: 31 - protein, 440 aa, Ostreococcus lucimarinus
MSASEVQAARDALAVTQVDGLSTDLAPVSSFADAGFSKELLRVTAQFKTPSPIQAQSWPIIMSGHDMVGIAATGSGKTLAFGMPALTQIHSQPPCKPGQPICLVLAPTRELAQQTAKVFDDAGEASGVRCVCVYGGAPKYEQKAQMKAGGGAAVIVATPGRLRDFMEEGVIKLDRVTMLVLDEADRMLDLGFEPEIRAIAGATRADRQTVMFSATWPQSVQSLASEFMCNPIKVRIGAEGLKASQSITQIVEVVEPQDKDRHLARVMKQYLGKGKEVPRTLIFGLYKKECANLHQRLSREWPAVCIHGDMSQHDREKSVDAFKKGTSRILIATDVAARGLDIKEVEYVINYTFPLTTEDYVHRIGRTGRAGATGLAHTFFTLHDKARAGELVNVLRKAGAEVPEELTKFGTHVKKKESKLYGAHFKDVDMSVKATKITFD

SEQ ID NO: 32 - DNA, 1323 bp, Ostreococcus RCC809
atgtcggcgagtgatttggcggcggcgagagaaaagttggcggtgacgcaagtcgacgggttggagacggatttagcgcccgtgtcgacgttcgcggacgctggattctgcaaagagttgttgagagtcaccgcgcagtttcaaaagccttcaccgattcaagcgcaatcttggcccatcgtcatgagcggtcacgacatggtcggtatcgcggcgacgggttcgggaaagacgctcgcctttggcatgccggcgctgacacaaattcgatctcaaccggcgtgtaaaccgggcgaaccgatttgtttggttctcgcaccgacgcgtgagttggcacaacagacggcgagggttttcgacgacgccggcgaggcttcgggagttcgttgcgtgtgcgtgtacggcggttcgcccaagcacgaacaaaaggcggcgatgaaagccggtggcggagccacggtcatcgtcgcgactcctggtcgacttcgcgacttcatggaagagggcgtcatcaaacttcatcgagtgaccatgctcgtcctcgacgaggcggatcgaatgctcgacctgggctttgaacccgaaattcgagccatcgcgggcgcgacgagagccgatcgacaaaccgtcatgttttccgccacgtggcctcagagcgtgcaaagtctcgcggctgagttcatgcacgaacccgtcaaggtgagaatcggcgccgagggcttgaaggcttctcagagcatcacgcagatcgtcgaagtggtcgagccgcaagacaaggacagacatttggcgcgcgtcatgaagcagtatttgggcaagggcaaggacgttccgagaacgctcgtcttttgcctatacaagaaggaatgcgctaatctccatatgcgactcgcgcgtgagtggccggcggtgtgcattcacggcgatatgtcccagctcgatcgcgaaaagtcggtcgatgcgttcaaaaagggcacgtcgagaatcttaatcgccaccgacgtcgcggcgcgcggtctcgatatcaaggaggttgagtacgtcatcaattacacgtttccgctcacgacggaagattacgttcacagaatcggtcgtaccggacgtgcgggggcgaccggtttggctcacaccttcttcacggtgcacgacaaggcgcgggctggcgaactcgtcaacgtgttgcgaaaagctggcgcggaggtccccgacgatctcacaaagtttggtacgcacgtgaagaagaaggagagcaaactgtacggggcgcacttcaaggaggttgacatgtccgtcaaggctaaaaagatcacatttgattag

SEQ ID NO: 33 - protein, 440 aa, Ostreococcus RCC809
MSASDLAAAREKLAVTQVDGLETDLAPVSTFADAGFCKELLRVTAQFQKPSPIQAQSWPIVMSGHDMVGIAATGSGKTLAFGMPALTQIRSQPACKPGEPICLVLAPTRELAQQTARVFDDAGEASGVRCVCVYGGSPKHEQKAAMKAGGGATVIVATPGRLRDFMEEGVIKLHRVTMLVLDEADRMLDLGFEPEIRAIAGATRADRQTVMFSATWPQSVQSLAAEFMHEPVKVRIGAEGLKASQSITQIVEVVEPQDKDRHLARVMKQYLGKGKDVPRTLVFCLYKKECANLHMRLAREWPAVCIHGDMSQLDREKSVDAFKKGTSRILIATDVAARGLDIKEVEYVINYTFPLTTEDYVHRIGRTGRAGATGLAHTFFTVHDKARAGELVNVLRKAGAEVPDDLTKFGTHVKKKESKLYGAHFKEVDMSVKAKKITFD

SEQ ID NO: 34 - DNA, 1323 bp, Ostreococcus taurii
atgtcggccaaggacgtggcggccgcgagggaaacgctcgccatcacgcaggtggagggactggacgtcgatttggcgcccgtgagcacgttcgaggacgcgggattctccaaggaactcctcagagtgacggcgaactttcagaaaccgtcgccgattcaggctcaatcgtggccgatcgtcatgagcggaagagacatggttggtatcgcggcgactggctcggggaagacgctcgcgttcgggatgccggctctgacgcaaattcgctctcaaccgccgtgcaagccgggtcagcccatctgtttggtgcttgcgcccacgcgtgagttagcgcagcaaacggcaaaggttttcgacgacgctggtgaagcttcgggcgttcgttgcgtgtgtgtgtacggtggtgctccgaaatacgagcaaaagaacgcaatgaaagctggaggaggcgccgcggtcatcgtcgccacgccgggtcgacttcgcgactttatggaagaaggtgtgattaaactggatcgcgttacgatgctggtgctcgatgaagcggatcgtatgctcgatttgggtttcgaacctgaaattcgcgccatcgccggagccactcgcgctgataggcagactgtcatgttttccgcgacgtggccgatgagcgtgcaaagcctcgcctcggagttcatgtgcaatcctgttagagtacgaatcggttcggagggcttgaaggcgtctcaaagcatcactcaaatagtcgaagttgtcgagccgcaagacaaggatagacacttggctcgtgtcatgaagcaatatctgggcagtcccaaggattgcccaagaacactcatttttggtctttacaagaaggaatgcgcgaaccttcatcagcgattgtctcgtgaatggccggcggtgtgcattcatggtgacatgtcccaggctgaccgtgaaagatctgtcgaggcgttcaagaagggaacttcgcgaattttgattgccacggatgtcgcggcgcgcggtctcgacatcaagggagtcgaatacgtcatcaactacacatttcctctcacaactgaggattatgtccacagaatcggtcgaactggccgcgctggcgccacaggtctggcccacactttcttcactcagcatgacaaagcgcgagccggcgaactcgtgaacgtgttgcgcaaagcaggagccgaagttcccgaagatctcacgaagtttggtacccacgtaaaaaagaaggaaagcaagctttacggtgctcacttcaaggaagttgacatgaccgtgaaggctacgaaaatcacgttcgactaa

SEQ ID NO: 35 - protein, 440 aa, Ostreococcus taurii
MSAKDVAAARETLAITQVEGLDVDLAPVSTFEDAGFSKELLRVTANFQKPSPIQAQSWPIVMSGRDMVGIAATGSGKTLAFGMPALTQIRSQPPCKPGQPICLVLAPTRELAQQTAKVFDDAGEASGVRCVCVYGGAPKYEQKNAMKAGGGAAVIVATPGRLRDFMEEGVIKLDRVTMLVLDEADRMLDLGFEPEIRAIAGATRADRQTVMFSATWPMSVQSLASEFMCNPVRVRIGSEGLKASQSITQIVEVVEPQDKDRHLARVMKQYLGSPKDCPRTLIFGLYKKECANLHQRLSREWPAVCIHGDMSQADRERSVEAFKKGTSRILIATDVAARGLDIKGVEYVINYTFPLTTEDYVHRIGRTGRAGATGLAHTFFTQHDKARAGELVNVLRKAGAEVPEDLTKFGTHVKKKESKLYGAHFKEVDMTVKATKITFD

SEQ ID NO: 36 - DNA, 1449 bp, Physcomitrella patens
atggaggtggatgttgagaagaagaagaaaaagaaaaagaggaacaaaaagagcaagaagaaacagaagagtgaggttggtagcgtggcgaagacgtcggcggtagctgcagaagtggtggcaaatgagaagctgagtgttgttgtgacgggcagtggaagtgacaatcctaagtttaagaaacaagagaatttcaagctggaaggcgtgccgcccaccgtgctgcagtgctgtcaaggattcgagaaaccgtcgccaattcagggtcatgcatggcccttcttgcttgccggacgagacttgattggtattgctgcgacgggttcaggtaagacactcgcttttggaattcctgcaatgaagcacgtgctggacaaaatcacgaagacgaaagggaaaaaggcagcccctgtttgcctcgtgctcgcacccactcgggagcttgcgcagcaaatcgcagacgtgctggaggagtcgggcagtgcctgtggggtcggagttgtgtgtgtgtatgggggtacaccgaaaggtcctcaaaggagtgccctcaaggcaggggcaagggttgtggtggcgactccaggaaggctgcaggatttgatggaggagggtgtgtgctctttagaccaggttacgtatgtcgttttggacgaggccgacaggatgttggatttagggtttgaacctgcgattcgagcaattttgagcacatgctgccaagttaggcagacggtcatgttcagcgcgacctggccaatggcggtgtccaagttagctatggagttcatgaatgagaaagaccctgtgaaggttatggtaggatcacaggacttggcagccaatcatgacgtgactcagattgtggaagtgatcgaagacagagctcgagatgcccgactggaaacgttgcttcaaaaatatcacaagtcccgcacgaaccgagtgttagtgttcgtattgtacaagaaggaggcagtacgtgtggagactgctcttcaaaggcggggctggaaagtctctgcggttcacggagacaaaggccaatcagatcgcacgagagctgtaaattccttcaaggatgggacgcggcctctcttgattgccaccgatgtcgctgctagaggacttgacatacctgatgttgaatatgtcatcaactacagcttcccacttactacagaagattatgtacatcgaattggaagaacaggtagggctgggaagaaaggtctttcgcatacatttttcacgcaagctgaccgggccagagctggtgagctcgtgaatgtgctcagggaagcaggtcaaacagtcccagaggaacttctcaagttcggcactcatgtgaagaagaaagaatccaagctctatggtgcccatttcaaagaaattggcgcagattctggaaaagcgaagaagatcacatttggagactccgatgacgagtga

SEQ ID NO: 37 - protein, 482 aa, Physcomitrella patens
MEVDVEKKKKKKKRNKKSKKKQKSEVGSVAKTSAVAAEVVANEKLSVVVTGSGSDNPKFKKQENFKLEGVPPTVLQCCQGFEKPSPIQGHAWPFLLAGRDLIGIAATGSGKTLAFGIPAMKHVLDKITKTKGKKAAPVCLVLAPTRELAQQIADVLEESGSACGVGVVCVYGGTPKGPQRSALKAGARVVVATPGRLQDLMEEGVCSLDQVTYVVLDEADRMLDLGFEPAIRAILSTCCQVRQTVMFSATWPMAVSKLAMEFMNEKDPVKVMVGSQDLAANHDVTQIVEVIEDRARDARLETLLQKYHKSRTNRVLVFVLYKKEAVRVETALQRRGWKVSAVHGDKGQSDRTRAVNSFKDGTRPLLIATDVAARGLDIPDVEYVINYSFPLTTEDYVHRIGRTGRAGKKGLSHTFFTQADRARAGELVNVLREAGQTVPEELLKFGTHVKKKESKLYGAHFKEIGADSGKAKKITFGDSDDE

SEQ ID NO: 38 - DNA, 1539 bp, Sorghum bicolor
atgggccgcaatcttgacgccgagcaagcggaagcacccaggagcagcaagaaggagaagaagagcaagaaggacaagaagcggaagctggcagccgaggccgaggaggcggcggcggcggccgtgacggcgacagaggagaccgtgaagagcatcaagaagaagaagctggttgagaatggagccggcgcaggaggaggaggggaggcggagaacggcgctgagaagaccgtggcggtgaccgggaagggctccgaggaccccaagtacgcgccgctgcggtcgttctccgctgccgagctgccgtcccaggtgctcgattgctgcagcgcattcgcgcggccgtcgcccattcaggcacacgcctggccgttcctcctcgatggccgcgacttcatcggcatcgccgccaccggatcagggaagacaattgcctttggtgtgccggcgctgatgcacatcaggaagaaggtaggggggaaagcagtgaagaaggctgtgccacggtgcctcgtgctatcaccaacgagggagctcgctcagcagattgcagatgtacttagtgaggctggtgcaccatgtgggataaaatcagtctgcctttatggtggaactaaaaaggaaccccaaatatctgcccttaaatctggagtggatatagtcataggaactcctggtcgtatgaaagaccttattgaaatgggtgtttgccgtcttaatgaggtttcgttcgtggttctagatgaagcagataggatgctggatatgggttttgaacctgaagtcagggcaattttgagccaaacatcatctgtacgtcagatggttatgttcagtgcaacttggcctcttgctgtccacaaattagcccaggagtttatggatccaaatccaataaaggttgttattggatcagaagatcttgctgctaaccatgacgtgatgcaaattgttgaagtattggatgatagaacacgagattcaagattacttgccttgcttgacaaatatcatcaagcacaaagcaacagggttttggtttttgtgctgtacaagaaagaagctgcacgagtggaaacaatgcttcagagaaggggatggaaggctgtttcagtccatggagacaaagctcagcatgacagaacaaaagctttatctttatttaaagaagggaaatgccctttaatgattgctacagatgtcgcttcacgtggacttgatattcctgatgttgaagttgtcattaactatagttatcctttgaccactgaggattacgtccacaggataggaaggactggtcgtgctggcaagaaaggtgttgcacatacctttttcactcaagcgaacaaggcacttgctggtgaacttgtgaatgttttgcgggaggctgatcaggttgttcctccagcccttatgaaatttggcacacatgtcaagaaaaaggaatctaagttatatggatctcatttcaaggaaatcacagcagatgctcctaaatccacgaagatcacatttggtgattctgatgaggactga

SEQ ID NO: 39 - protein, 512 aa, Sorghum bicolor
MGRNLDAEQAEAPRSSKKEKKSKKDKKRKLAAEAEEAAAAAVTATEETVKSIKKKKLVENGAGAGGGGEAENGAEKTVAVTGKGSEDPKYAPLRSFSAAELPSQVLDCCSAFARPSPIQAHAWPFLLDGRDFIGIAATGSGKTIAFGVPALMHIRKKVGGKAVKKAVPRCLVLSPTRELAQQIADVLSEAGAPCGIKSVCLYGGTKKEPQISALKSGVDIVIGTPGRMKDLIEMGVCRLNEVSFVVLDEADRMLDMGFEPEVRAILSQTSSVRQMVMFSATWPLAVHKLAQEFMDPNPIKVVIGSEDLAANHDVMQIVEVLDDRTRDSRLLALLDKYHQAQSNRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKESKLYGSHFKEITADAPKSTKITFGDSDED

SEQ ID NO: 40 - DNA, 1446 bp, Volvox carteri
atggttggtgacgctcagctggcgaatgctggcaagccaataatcaagtcgttgtacaacgaacaccccgacgtcaccgcgttcacagctgagcgtgtagccgaggtgcgctctgagcggcgcatcactattgagggctttggtccggaggacgactttgaggcgggcggccctacggacataaagccggtgctcgcgttcgagcacacggggctcccgtcggacatgcttcacgccacacggaacttcgtgtcgcccagccctatccaggctcagtgctggcccatcatcctggcgggacgggacctgattggtatcgcagccacgggcagcggcaagacgctcggttttggactccccatgctccggcacatcgccgcccagcgcgacaacggtgtggtgtccggtaagggcccgtttgccatcgtgatggcgcctacccgggagctggccttgcaaatcaaccaggtcttggaggaagctgggagccagtgcagcgtgcggaccgtctgcgtttatggcggtgttcccaagggaccccaggtggccgcgctcaaaagcggtgtggaagttgtggtgggcactcccggccgcatggaggacctgctcaacgacggggtgctgcagctcaagaaggtcacatacgccgtccttgacgaggcggatcgtatgctcgatttgggcttcgagccgcacatccgtgcaatcatggggcttactcgggccgaccggcagacgcttatgttcagcgcaacgtggcctgcggcggtgcagaaactggccattgcgttcttgtcacatcccgtgaaggtcaccattggaagccaggaccttgctgccagtcattcgatcactcagcgggtggatgtcattgatccgaatgcgcgtgacggcaggctgcttgagctacttcagcagtaccacggcgcgaagggtcgcaagaaccgtgtcatcatttttgtgctctacaagaaggaggctccgcgcgttgagcaactgctcagccgcaaaggctggaaggctgttgccattcacggcgacattagccagcagcagcggacggacgctgtggataagttcaagtcgggggtcgtgcctttgcttattgcgacggatgtggctgcgcgcggcttggacatcccggacgttgaggtcgttatcaattactccttcccacttaccacagaggactacgtgcatcgcataggtcgcacaggccgagcggggaagactggtatcgcccacactttcttctgcgctggaccagacaagccccgggcaggcgagcttataaacgtgctacgggaggcggggcaagaggtcccggctgaactcctcaagtttgggacggcggtcaagaagaaggagtcaaagatgtatggcgcacacttccgtgatgtcgacgtgcacgcgaaagcaagcaaagtcactttcgatgatgactaa

SEQ ID NO: 41 - protein, 481 aa, Volvox carteri
MVGDAQLANAGKPIIKSLYNEHPDVTAFTAERVAEVRSERRITIEGFGPEDDFEAGGPTDIKPVLAFEHTGLPSDMLHATRNFVSPSPIQAQCWPIILAGRDLIGIAATGSGKTLGFGLPMLRHIAAQRDNGVVSGKGPFAIVMAPTRELALQINQVLEEAGSQCSVRTVCVYGGVPKGPQVAALKSGVEVVVGTPGRMEDLLNDGVLQLKKVTYAVLDEADRMLDLGFEPHIRAIMGLTRADRQTLMFSATWPAAVQKLAIAFLSHPVKVTIGSQDLAASHSITQRVDVIDPNARDGRLLELLQQYHGAKGRKNRVIIFVLYKKEAPRVEQLLSRKGWKAVAIHGDISQQQRTDAVDKFKSGVVPLLIATDVAARGLDIPDVEVVINYSFPLTTEDYVHRIGRTGRAGKTGIAHTFFCAGPDKPRAGELINVLREAGQEVPAELLKFGTAVKKKESKMYGAHFRDVDVHAKASKVTFDDD

SEQ ID NO: 42 - DNA, 1650 bp, Vitis vinifera
atggggcgaagattggaagagactgtcctgcatagcgaaccagttgccctacaaatcccaaccaaccgcgaaatcaaagctgagaagaagaagaagaagaagcataaacagtccaaaatcgcttctaatgaagtggtagaaattgggaggaagaagaagaacgaagactacataatcgaagaagaaacagaggctaaccgaaagagaaagctcgaagaaacgccaactgtaacagaggcgaagaagaagaagaaggagaaggagaagaaggagaagaaggagaaagagggagaagaagaaggcttgaaggatgaagatgataaggagagcagaggggcgtgcgtggcggtgactggaaaggacgcgaaggaatcgaagtatgcggctttcaaatcatttgccgagtcgaagctgccggatgatgtgctcgagtgttgccgcaatttcagccagccctcaccgattcagtcccatgcctggccgttcttgttggaccaccgggattttatcgggattgctgctactgggtctggtaagacattggcatttggagttccagcaatgatgcatgttttgagtaagcggaagagtaaaacatccaagggagtgaatcccctttgccttgtcttgtcaccgacgagggagctagctcagcaaatttcagatgttctgtgcgaggctggaaaacattgtggtgtgaagtcagtttgcttgtatggaggaacttctaaaggacctcaaataagttccctgaagtctggtgttgacattgtcataggtactcctggacgtttgaaggatctaattgaaatgggtgtgtgttgccttacagaggtatcttttgtggtgttagatgaagcagatcgtatgctggacatgggatttgaaccagaagttcgctctatattaagccagacatgtcctgctcgccaaatggtaatgtttagtgcaacatggcctctacctgttcatcaattagctcaagaatttatggatcccaacccagttaaggttgtaataggttcagaggatttagctgccaaccatgatgttatgcaaatagtggaggtcttggatgatcgatcacgtgatgaacgtctgctcactttgttagggaaataccacaagtcccaaaggaacagagtgttagtttttgttttgtacaagaaagaagctgctcgtgttgaaaatatgctacaaagaaggggttggaatgttgtttctatacatggtgataaagcgcaacaagcacgtacagcggcattatcattattcaagaagggaagctgtcctttgatgatagctacagatgtggctgcacgaggattggatattccagatgtggaagtagtgatcaactacagttttcctctcactacagaggattatgttcacagaattggaagaactggacgagctggtaagaagggtgttgcacacacattcttcatgcaggaaaacaagggacttgctggggagttggtgaatgttctcaaagaagcagggcagattgtccctgctgaccttttaaaatttggcacacatgtaaagaaaaaggagtccaagctatatggggctcacttcagagaaattgctgctgatgctccaaagtccaaaaagatcacttttgacgactctgatgaagattga

SEQ ID NO: 43 - protein, 549 aa, Vitis vinifera
MGRRLEETVLHSEPVALQIPTNREIKAEKKKKKKHKQSKIASNEVVEIGRKKKNEDYIIEEETEANRKRKLEETPTVTEAKKKKKEKEKKEKKEKEGEEEGLKDEDDKESRGACVAVTGKDAKESKYAAFKSFAESKLPDDVLECCRNFSQPSPIQSHAWPFLLDHRDFIGIAATGSGKTLAFGVPAMMHVLSKRKSKTSKGVNPLCLVLSPTRELAQQISDVLCEAGKHCGVKSVCLYGGTSKGPQISSLKSGVDIVIGTPGRLKDLIEMGVCCLTEVSFVVLDEADRMLDMGFEPEVRSILSQTCPARQMVMFSATWPLPVHQLAQEFMDPNPVKVVIGSEDLAANHDVMQIVEVLDDRSRDERLLTLLGKYHKSQRNRVLVFVLYKKEAARVENMLQRRGWNVVSIHGDKAQQARTAALSLFKKGSCPLMIATDVAARGLDIPDVEVVINYSFPLTTEDYVHRIGRTGRAGKKGVAHTFFMQENKGLAGELVNVLKEAGQIVPADLLKFGTHVKKKESKLYGAHFREIAADAPKSKKITFDDSDED

SEQ ID NO: 44 - DNA, 1506 bp, Arabidopsis thaliana
atgagtcgctacgatagccggaccggcgattccacctcgtaccgtgaccgtcgaagtgactcagggtttggtgggacttcatcatatggaagctcaggtagtcatacatctagcaaaaaggataacgatggcaatgaatctccaaggaagctagatttagatggtttgactccttttgagaagaatttttatgtcgagtctcccgctgtggcggctatgacagacacagaagtagaggaatatcgaaagctaagggaaattactgttgaaggcaaagatattccaaaacctgtcaagagttttcgtgatgttggctttcctgattatgttttggaagaggttaagaaggctggttttactgaacctacgcctatacaatctcaggggtggccaatggctatgaagggacgtgatcttatcggcattgctgaaactggttctggaaagactctttcttacttactacctgctattgtccatgttaatgcccaaccaatgttagctcatggtgacggcccaatcgtcttggttcttgctcccactcgtgaactggctgtgcagatacagcaagaggcatctaaatttggttcatcctcaaaaattaagaccacttgcatttatggtggggttccaaaagggcctcaagtgcgtgatctccagaaaggtgtggagatcgttatagctactcctgggaggttaatagacatgatggagtcgaacaacacaaacctacgaagggttacttatcttgttttggatgaggctgatcgaatgcttgatatggggtttgaccctcagatccggaaaattgtttcacatattcggccagaccgtcaaactttgtactggagtgccacttggcctaaggaggtggaacaactatcgaagaagtttctttataacccatacaaagtgataataggatcttctgatttgaaagctaaccgtgcaattcgtcaaattgttgatgtcatttccgaaagccaaaagtataacaagttggtgaaactgcttgaggacataatggatggaagcagaattcttgtcttcctcgatacaaaaaagggctgtgaccaaatcactcgtcagcttcgcatggatggttggcctgctttgtcaatacatggagataaaagtcaagcggaaagagattgggttctctcggagtttagatcaggcaaaagccctataatgactgctacagacgttgcagctcgtggattagacgtgaaagatgtgaagtatgtgataaactatgacttccctggatcactggaggattatgttcacaggattggacgaacaggtagagccggggctaaaggaacagcttacactttcttcacagttgcaaatgcgagattcgccaaggaacttaccaacatactacaagaagctggacagaaagtgagtcccgaattggcttcaatgggtcgcagtaccgctcctcctcctccagggcttggaggattcagagaccgtgggagcagaagagggtggagctga

SEQ ID NO: 45 - protein, 501 aa, Arabidopsis thaliana
MSRYDSRTGDSTSYRDRRSDSGFGGTSSYGSSGSHTSSKKDNDGNESPRKLDLDGLTPFEKNFYVESPAVAAMTDTEVEEYRKLREITVEGKDIPKPVKSFRDVGFPDYVLEEVKKAGFTEPTPIQSQGWPMAMKGRDLIGIAETGSGKTLSYLLPAIVHVNAQPMLAHGDGPIVLVLAPTRELAVQIQQEASKFGSSSKIKTTCIYGGVPKGPQVRDLQKGVEIVIATPGRLIDMMESNNTNLRRVTYLVLDEADRMLDMGFDPQIRKIVSHIRPDRQTLYWSATWPKEVEQLSKKFLYNPYKVIIGSSDLKANRAIRQIVDVISESQKYNKLVKLLEDIMDGSRILVFLDTKKGCDQITRQLRMDGWPALSIHGDKSQAERDWVLSEFRSGKSPIMTATDVAARGLDVKDVKYVINYDFPGSLEDYVHRIGRTGRAGAKGTAYTFFTVANARFAKELTNILQEAGQKVSPELASMGRSTAPPPPGLGGFRDRGSRRGWS

SEQ ID NO: 46 - DNA, 1455 bp, Arabidopsis thaliana
atgagctcgtatgatcgtagatttgctgatccaaattcgtatcgccaacgctctggcgccccagttggttcgtctcagccgatggatccttccgccgcaccatacaacccacggtacactggtggtggtggaggatatggaccatctccggtaatggccggtgataattccggctataatcggtacccatctttccagccacctagtggcggtttctctgttggccgcggtggtggaagaggtggatatggtcaatacggcgatagaaacggcggagggaattggggaggaggaggaggacgtggcggatcgagtaaaagagagctagatagtgtttctcttccgaagcagaattttgggaatcttgtacattttgagaagaatttctatgtggagagtcccactgtgcaagctatgacagagcaggatgttgcaatgtacagaaccgagagggatatatccgttgaaggtcgtgatgttcctaagccgatgaagatgttccaagatgctaactttccagataacattcttgaagcaattgctaaattgggatttactgagccaacacctatacaagctcagggatggccgatggcgttgaagggtagggatttgattggtattgctgagactggctctggtaagacattggcttacttgttaccagcattggttcacgttagtgcacaacctcgattaggtcaggatgatggccccattgtgttaatattagctcccacaagagaactagctgttcagattcaagaggaatcaaggaaattcgggttgaggtctggtgttagaagtacttgtatctatggtggtgctcctaaaggacctcagattcgtgatcttagaagaggtgttgagattgtaattgctacacctggtcgtttgattgatatgttggaatgtcaacacactaatttgaagagagtgacttaccttgtactggatgaggctgacagaatgttagacatgggatttgaaccccaaattagaaagattgtatctcagatccgacctgatagacaaacacttctttggagtgcaacatggccacgagaggttgaaactcttgccaggcagtttctacgagatccatataaggccattattggatcaacagatctaaaagctaaccagtctattaaccaagtaatcgagattgtaccgacgccagagaaatacaacaggctccttacactacttaaacagttaatggatgggagtaaaatcctaatttttgtggagacaaagagagggtgtgatcaagtgactagacaattgagaatggacggatggccagctcttgccatacatggtgacaagacccaatcggaaagagaccgagtcttggcagaatttaagagtggacgaagcccgataatgactgccactgatgtagcagcaaggggacttgtttcctctggtattagggaaaaaagcacatag

SEQ ID NO: 47 - protein, 484 aa, Arabidopsis thaliana
MSSYDRRFADPNSYRQRSGAPVGSSQPMDPSAAPYNPRYTGGGGGYGPSPVMAGDNSGYNRYPSFQPPSGGFSVGRGGGRGGYGQYGDRNGGGNWGGGGGRGGSSKRELDSVSLPKQNFGNLVHFEKNFYVESPTVQAMTEQDVAMYRTERDISVEGRDVPKPMKMFQDANFPDNILEAIAKLGFTEPTPIQAQGWPMALKGRDLIGIAETGSGKTLAYLLPALVHVSAQPRLGQDDGPIVLILAPTRELAVQIQEESRKFGLRSGVRSTCIYGGAPKGPQIRDLRRGVEIVIATPGRLIDMLECQHTNLKRVTYLVLDEADRMLDMGFEPQIRKIVSQIRPDRQTLLWSATWPREVETLARQFLRDPYKAIIGSTDLKANQSINQVIEIVPTPEKYNRLLTLLKQLMDGSKILIFVETKRGCDQVTRQLRMDGWPALAIHGDKTQSERDRVLAEFKSGRSPIMTATDVAARGLVSSGIREKST

SEQ ID NO: 48 - DNA, 1515 bp, Aquilegia sp.
atgagtcgttacgatagccgttcaggtgaccctgcatcgtatcgtgaaagaagaagtgattctggttttggtagtggtggtggttatgaaagtaatattaataataataagaaggaatttgatagaggtgctggtgctgcttcaacactagacttagatggtttaacccattttgagaaaaatttctatattgaatcatcttcaatatcttcaatgactcaagatgaagttgatgcttatcgtttaaaaagacaaattactgttgaaggcaaagatatacctaaacctgttaaagaatttcgcgacattggttttccagagtacgtcatggaagaagttctgaaagcaggatttgttgaacctacccccattcaagctcagggatggccaatggctttgaagggccgagatctcatcggtattgccgaaacaggatcaggaaaaacacttgcgtatctactgcctgccattgtccatgttaatgctcagccaattttagctccaggagacggcccaattgttttagttttagcgccaactcgtgagcttgctgtgcaaatacaacaagaagctactaaatttggggcatcgtcaagaattaagaatacctgtatatatggtggggttcctaaaggacctcaagtacgtgatctccaaaaaggtgttgaaattgttattgccacccctggaaggctgatcgatatgttagaatctcatcatacaaacttaagaagggttacctaccttgttttggatgaggcggatcgaatgttagacatgggttttgaacctcagatgaagaaaattgtttctcagattcgtccagatcgccagaccttgtattggagtgctacctggcctaaggaggttgaactacttgcaaggcagttcctctacaacccatacaaggtggtcattggctcccaggatttgaaagctaaccatgctattcatcagcatgtggagattgtttctgagaatcagaaatataagaagttggtaactcttttggaggacatcatggatggtagtcggattcttatattcatggacaccaagaaagggtgtgaccagatcactaggcagcttcgcatggatgggtggcctgccctctcaatccatggggataaaagtcaagctgagagggattgggtcctttcagagttcaaggctggaaagagtccaataatgacagctacagatgttgcagctcgtggtttggatgtgaaggatgtaaaatatgtgatcaattatgattttccggggtccttggaggattatgttcatcgcatagggcgaacaggaagggctggtgccaaaggaactgcatacacattctttacggcggcaaatgccagatttgctaaagaacttattgtcatccttgaggaagctggacagaaggtcaatcccgaattggcgaaaatgggacgaggtatcccccctccaccaacaggtcagggtggcttccgtgatcgtggaaggggtttaggtggcggtcggtcatggaattaa

SEQ ID NO: 49 - protein, 504 aa, Aquilegia sp.
MSRYDSRSGDPASYRERRSDSGFGSGGGYESNINNNKKEFDRGAGAASTLDLDGLTHFEKNFYIESSSISSMTQDEVDAYRLKRQITVEGKDIPKPVKEFRDIGFPEYVMEEVLKAGFVEPTPIQAQGWPMALKGRDLIGIAETGSGKTLAYLLPAIVHVNAQPILAPGDGPIVLVLAPTRELAVQIQQEATKFGASSRIKNTCIYGGVPKGPQVRDLQKGVEIVIATPGRLIDMLESHHTNLRRVTYLVLDEADRMLDMGFEPQMKKIVSQIRPDRQTLYWSATWPKEVELLARQFLYNPYKVVIGSQDLKANHAIHQHVEIVSENQKYKKLVTLLEDIMDGSRILIFMDTKKGCDQITRQLRMDGWPALSIHGDKSQAERDWVLSEFKAGKSPIMTATDVAARGLDVKDVKYVINYDFPGSLEDYVHRIGRTGRAGAKGTAYTFFTAANARFAKELIVILEEAGQKVNPELAKMGRGIPPPPTGQGGFRDRGRGLGGGRSWN

SEQ ID NO: 50 - DNA, 1542 bp, Chlamydia reinhardtii
atgtcgcactactcaagccacggaaggggggatgaccggtggggaggaggaggctcgtcttatggcggaggcggaggcagctcgcgatgggacagtggaggtcacggcggtggaggcggaggcggaggctttaacactcgcggaggtcgcgatgacctcgatcgtatggcgttaccccgccccgactttacgaacctgccaaagttcgagaaatgtttctacctggagcacccagccgttagcgggcggacacctgaggaggtggagcagtaccggcgcgaaaaacagattcacgtctacggggatggcgtgccgaagccggtgaagacgtttgaggaggcatctttccctgagtacgtgctggaggaggtgctgcgggcgggcttcaaggagccaacgcccatccagtgccagggctggccgatggccctgctgggccgcgacctcatcggcctggcggagaccggcagtggcaagacgctggcgtacctgctgccggccgtggtgcacatcaacgcgcagccctacctacagtccggcgatggccccatcgtgctggtgctggcgcccacgcgcgagctggcggttcagatccagcaggagtgccagcgcttcggcgcctccagccgcatcaagaacaccgtcgtgtacggcggtgcgcccaagggcccccaggcgcgcgacctgcgcggcggcgtggagatcgtcattgccacgccgggccgccttatcgacatgctggacagccgcatcaccaacctgcggcgtgtgacatacctggtgctggacgaggcggaccgcatgctggacatgggctttgagccgcagatccgcaagattgtggaccagatccggcccgaccgccagacgctgctgtggtcggcgacgtggcctaaggaggtgcaggccattgcgcgcgacttcctcaaggacccctaccaggtgatcatcggctcgcccgacctcaaggccaaccacaacatccggcaggtggtggagatggtggagggcttcgccaagtacccgcgcctgcgcaagctgctggacggcgagatggacggcaggcgtatcctcatcttcgtggagacaaagcgcggctgcgacgagctggtgcggcagctgcgcacggacggctatccggcgcttggtctgcacggcgacaagagccagcaggagcgcgactgggtgctgcaggagttcaagaacggcacgcaccccatcatgctcgccacggacgtggccgcacgtggactagacgtcaaggacatcaaggtggtggtgaactacgacatgcccaagacggccgaggactacgtgcaccgcatcggccgcacggggcgcgctggcgccactggcactgcctactccttcttcaccaacggcgacgcgcgcctggcgcggcaggtggtggacgtgatgcaggaggctggtcagcagccgccgccggagctgatgcagatgatgtcgttcggcggcggaggcggaggcggtgagtggggggggctggttcggcgcaggttgtgctgcgcattggctgcataa

SEQ ID NO: 51 - protein, 513 aa, Chlamydia reinhardtii
MSHYSSHGRGDDRWGGGGSSYGGGGGSSRWDSGGHGGGGGGGGFNTRGGRDDLDRMALPRPDFTNLPKFEKCFYLEHPAVSGRTPEEVEQYRREKQIHVYGDGVPKPVKTFEEASFPEYVLEEVLRAGFKEPTPIQCQGWPMALLGRDLIGLAETGSGKTLAYLLPAVVHINAQPYLQSGDGPIVLVLAPTRELAVQIQQECQRFGASSRIKNTVVYGGAPKGPQARDLRGGVEIVIATPGRLIDMLDSRITNLRRVTYLVLDEADRMLDMGFEPQIRKIVDQIRPDRQTLLWSATWPKEVQAIARDFLKDPYQVIIGSPDLKANHNIRQVVEMVEGFAKYPRLRKLLDGEMDGRRILIFVETKRGCDELVRQLRTDGYPALGLHGDKSQQERDWVLQEFKNGTHPIMLATDVAARGLDVKDIKVVVNYDMPKTAEDYVHRIGRTGRAGATGTAYSFFTNGDARLARQVVDVMQEAGQQPPPELMQMMSFGGGGGGGEWGGLVRRRLCCALAA

SEQ ID NO: 52 - DNA, 1518 bp, Gossypium hirsutum
atgagtcgatacgatagccgttccggcgatcccacctcttaccgcgatcgtagaagtgactcagggtttggtggggcttcagcttatgacggttcagtgtggtcctcatcaagcagaagggattatgatggtgctgaaccgcctaggaagttggatttggatgggttgaccccttttgagaagaatttttatattgagtcaccatcagtggcggcaatgtctgatgcggaggttgaggattatcggcggcgaagggaaattacggttgaaggtcgtgatgttccaaagcctgtgaatagttttcgtgacatcgggtttccagactatgtactgcaagaaatcacaaaagctggatttgttgaaccaacagccatacaagctcaaggctggccgatggctttgaagggccgtgatctcattggtattgctgaaacagggtcagggaagactcttgcctatttattgccctcaattgtccatgtcaatgcacagccaattttagctcctggagatggtcctattgtactagtcttagctccgacacgcgagcttgcagttcaaatacaacaagaggctgctaagtttggtgcatcatcaaggatcaagaatacatgcatatacggaggggttccaaagggacctcaagtccgtgatctccagaaaggtgttgagattgttattgctacaccagggaggttgatagatatgttggagtcaaatcacacaaatttgcgaagagttacatatttagtgttggatgaggcagatcggatgttggatatggggtttgaacctcagataaggaaaatcgtttctcagatccgccctgaccgtcaaactttgtattggagcgcgacttggccgaaggaggttgaacagttggcaaggcagtttctttacaacccatacaaagtggtaattggatctgcagatttaaaggctaaccatgcaattcgccaacatgttaacattgtttcagagagtcagaaatataacaaattggtgaagctgctcgaggatatcatggatggcagcagaattttgattttcatggataccaagaagggttgtgaccaaatcactaggcaacttcgcatggatggttggcctactctgtcaattcatggagataaaagtcaagcagaaagggattgggtcctttcagagtttaaagctggcaagagccctataatgactgcaacagatgttgcagctcgtggtttagatgtgaaagatgtgaagtatgtaatcaattatgacttcccgggatctctcgaggattatgtccatcgcattggtcgaacagggagggcaggggcaaaaggaacagcctatactttcttcacagctgcaaatgcaagatttgcgaaagaacttattgccatacttgaggaagctggccagaaggtcagtcctgaattggcagcaatgggacgcggtgcacctcctcccccatcaggtcatggtggttttcgagaccgaggtaagggatacagtggcggtcgcccatggagctga

SEQ ID NO: 53 - protein, 505 aa, Gossypium hirsutum
MSRYDSRSGDPTSYRDRRSDSGFGGASAYDGSVWSSSSRRDYDGAEPPRKLDLDGLTPFEKNFYIESPSVAAMSDAEVEDYRRRREITVEGRDVPKPVNSFRDIGFPDYVLQEITKAGFVEPTAIQAQGWPMALKGRDLIGIAETGSGKTLAYLLPSIVHVNAQPILAPGDGPIVLVLAPTRELAVQIQQEAAKFGASSRIKNTCIYGGVPKGPQVRDLQKGVEIVIATPGRLIDMLESNHTNLRRVTYLVLDEADRMLDMGFEPQIRKIVSQIRPDRQTLYWSATWPKEVEQLARQFLYNPYKVVIGSADLKANHAIRQHVNIVSESQKYNKLVKLLEDIMDGSRILIFMDTKKGCDQITRQLRMDGWPTLSIHGDKSQAERDWVLSEFKAGKSPIMTATDVAARGLDVKDVKYVINYDFPGSLEDYVHRIGRTGRAGAKGTAYTFFTAANARFAKELIAILEEAGQKVSPELAAMGRGAPPPPSGHGGFRDRGKGYSGGRPWS

SEQ ID NO: 54 - DNA, 1524 bp, Glycine max
atgagccgctacgacagccgctccggcgacccagcttcctatcgtgatcggaggagtgattctgggctaggtgcacctacagggtttggtggttctgtacaacactcttcatcaaacaggagggattatgatgatggtgggtcaccaaagaggaacctcagtttggatggtttacctcattttgagaaaaacttctacattgagtcaccagctgtaagggcaatgacagatgctgaagttaatgagtatcggcagcagagggaaataactgttgaagggcgagatatcccgaaacctgtcaagacctttcacgatgctggttttccagaatatgtactgcaagaaattacaaaagctggctttactgaacctacacccattcaatctcaaggttggcccatggctttgaaggggcgtgatctgataggaattgcagaaacaggatcagggaagacacttgcttacttgttgcctgccattgtgcatgttaatgctcagccaatactaaatcctggagatggaccaattgtgctagttttggctccaactcgtgaacttgctgtccaaatacaacaagagactactaaatttggtgcatcatctaggattaagagtacatgcatctatggtggggttcctaagggacctcaggtgcgtgatctccagaaaggtgtcgaaattgtaattgccactccaggaaggttaattgatatgcttgagtcaaatcataccaacttgcagagggtcacataccttgtattggatgaagctgataggatgttggatatggggtttgatcctcagctacggaagattgtctctcagattcgtccagatcgtcaaactttgtattggagtgctacctggccaaaggaggttgaacaattggcaaggaagttcctttataacccatacaaagtaattataggctcttcagatttaaaagctaaccatgcaatacggcaatatgttgacattgtttcggaaaagcagaaatatgataaattggtaaagttgctagaagacatcatggatggcagccgaatactgatatttatggataccaaaaaaggatgtgatcagattactaggcaactccgcatggatggatggcctgcactttcaattcatggagataaaagtcaagcagaaagagattgggtgctctcagaatttaaatcaggaaaaagtcctattatgacggcaacagatgttgcagcccgtggtttagatgtgaaggatgtaaaatatgttgtaaattatgacttcccggggtcacttgaggattatgttcatcgcattgggcggacagggagggctggtgcaaaaggaactgcgtacacatacttcacagctgctaatgccagatttgctaaggaacttatagccatactcgaggaagctggacagaaagtgagtcctgaattagcagcaatggggcgtggtgcaccacctccaccttcaggtccccgaggtttccaagaccgcgggaggggttatggcagttctcgtccatggagctga

SEQ ID NO: 55 - protein, 507 aa, Glycine max
MSRYDSRSGDPASYRDRRSDSGLGAPTGFGGSVQHSSSNRRDYDDGGSPKRNLSLDGLPHFEKNFYIESPAVRAMTDAEVNEYRQQREITVEGRDIPKPVKTFHDAGFPEYVLQEITKAGFTEPTPIQSQGWPMALKGRDLIGIAETGSGKTLAYLLPAIVHVNAQPILNPGDGPIVLVLAPTRELAVQIQQETTKFGASSRIKSTCIYGGVPKGPQVRDLQKGVEIVIATPGRLIDMLESNHTNLQRVTYLVLDEADRMLDMGFDPQLRKIVSQIRPDRQTLYWSATWPKEVEQLARKFLYNPYKVIIGSSDLKANHAIRQYVDIVSEKQKYDKLVKLLEDIMDGSRILIFMDTKKGCDQITRQLRMDGWPALSIHGDKSQAERDWVLSEFKSGKSPIMTATDVAARGLDVKDVKYVVNYDFPGSLEDYVHRIGRTGRAGAKGTAYTYFTAANARFAKELIAILEEAGQKVSPELAAMGRGAPPPPSGPRGFQDRGRGYGSSRPWS

SEQ ID NO: 56 - DNA, 1809 bp, Glycine max
atgaacccctacgacaatagatattccgacgccgcttcttttcgcggccgtcgcagtgatttcgttggacctattccgcctccgtctttcgtcggccgcggcggcgcagttccctacggcgtccccggacccaacgggttcggatccgcacccgttgctccggtaccaccctttgtgcctccttccggaggcttcaacgtaggtcgaggcggtggcagagcgggcaatggtcccgtgagtgatagaaaacacgacatgggtcgtggccgtggtggcggcggcggtggtagagccggagctcacggttttaggggctccgcgagaggaggaggtagacacggtggtggttcttctagggatgatttgaacaacattgcactcccgaagcaggattttaagaatttggtcccttttgagaagaacttctatgttgagtgccctgccgtgagggccatgtctgagcaagaagttttgcattaccgtgccagtagagagatcaccgtgcaaggcaacgatgtgccaaagcctattatgatgtttcacgaggcgaattttcctgattactgccttgaggttattgccaatctgcgttttgctgatcccactccaattcaagctcagggttggcccatggctctgaagggtagagatttaattggcattgccgagactggctcgggtaaaactttggcgtatttgcttcctgctttagtgcacgtcaatgcacaacctcgattggcacatggggatggtcccattgtcttagttttagcaccaactagagagttggctgttcaaattcaggaagaggctcttaaatttgggtctcgggcaaataaaagaagtacgtgcatctatggtggtgcaccaaagggtccccaaattcgggagcttaaaagaggcgtcgaaatagttattgctacacctggtcgtctaatagatatgttggaagctcagcacacgaacctgcggagagtgacttaccttgtcttagatgaagctgatcgaatgctagacatgggttttgaacctcagatacggaaaattgtagcccagattcgaccagataggcaaacattattatggagtgctacatggccaagggatgttgaaactctggcaaggcagtttctgcacaacccatacaaggtaattattgggtcaccatacctgaaggcaaatcaatctataaatcaaattgttgaagttgtaacagacatggagaaatacaatagattaatcagactgctgaaagaagtgatggatggtagccgaattttaatatttatggagacaaaaaagggatgtgatcaagttacgagacaaatgagagtggatggatggccagcactatccatccatggtgataaaaaccaggctgaaagggattgggtcttggctgaatttaagagtggcagaagtccaataatgactgccactgatgttgctgcacggggtcttgatgtgaaagacataaaatgtgtgatcaattatgattttccaacaagcctggaagattatgtccacagaattggtcgaactggtcgtgcaggggctaaaggaactgcatacaccttttttacacatgccaatgctaagtttgctagggatctgattaagattttacaagatgctggtcagactgtgagtcctgcgttgactgcattggttcggtcagctggttctggtcaatttggatcagggggaggttttcgctcaagaggacgaggaggctatggaaatcgtggtttaacgtcaggttccaatgccattcctctaggttcgaagcggccctggcattgtctatag

SEQ ID NO: 57 - protein, 602 aa, Glycine max
MNPYDNRYSDAASFRGRRSDFVGPIPPPSFVGRGGAVPYGVPGPNGFGSAPVAPVPPFVPPSGGFNVGRGGGRAGNGPVSDRKHDMGRGRGGGGGGRAGAHGFRGSARGGGRHGGGSSRDDLNNIALPKQDFKNLVPFEKNFYVECPAVRAMSEQEVLHYRASREITVQGNDVPKPIMMFHEANFPDYCLEVIANLRFADPTPIQAQGWPMALKGRDLIGIAETGSGKTLAYLLPALVHVNAQPRLAHGDGPIVLVLAPTRELAVQIQEEALKFGSRANKRSTCIYGGAPKGPQIRELKRGVEIVIATPGRLIDMLEAQHTNLRRVTYLVLDEADRMLDMGFEPQIRKIVAQIRPDRQTLLWSATWPRDVETLARQFLHNPYKVIIGSPYLKANQSINQIVEVVTDMEKYNRLIRLLKEVMDGSRILIFMETKKGCDQVTRQMRVDGWPALSIHGDKNQAERDWVLAEFKSGRSPIMTATDVAARGLDVKDIKCVINYDFPTSLEDYVHRIGRTGRAGAKGTAYTFFTHANAKFARDLIKILQDAGQTVSPALTALVRSAGSGQFGSGGGFRSRGRGGYGNRGLTSGSNAIPLGSKRPWHCL

SEQ ID NO: 58 - DNA, 1362 bp, Ostreococcus RCC809
atggatgcgtcagcgcgtgggggcgacgagaggcgcgcgtcgacgagcgaacgggaagatgatgacgcgtcccggtggttgtttgagaagaatttttattacgagcacccgaacgtgtcggctcggacgctcgcggaggtggaacgggagatggtgaggcgggagatacgcgtggtgcgaggggtgaacgtgccgaagtgcgtgcgaacgttcgaggaggcgtcgtttccgacgtatgtgaatgacgatttggcgagggaggcgttcgccgaaccgagcgcggtacagtcgcaggcgtggcccatcgcgctgagtggacgagatttgatcgcgctggcggagacggggtcggggaagacgttggcgtatctgttacccgccatcgtgcacgtgaacgcgcagccgattttggagagcggggaggggcccatcgcgctcgtgttggcgccgacgcgcgagttggcgtgtcaaatcgagctcgaggtggcgaaatatgccgcgtcgagcgaactgaagcacacgtgcgtgtacggaggcgtgccaaaaggtcctcaggtgaaggcgctgcgctcaggtcgaagcgagatttgcgtggcgaccccgggtcggttgctcgattttctcgacggcgggcagacgaatttgcgccgaaccacgtttgtggtgctcgacgaagcggatcgcatgttagacatgggtttcgaaccgcagattcgacgcatcgtgcaacaaaccaggccggacaggcagacgctcctcttcaccgcgacgtggcccgtggaggtgcgcgaagccgcgagagagtttgtgcgaaacgaccccgtggaggtgcgcgtgggcggcacgggcgacggactcctcgccagtaagaacgtcgaacaaatcgttcacgtcatgggaccagacgaaaaatacgacgcgctcgtgtccacgctcgagaaagagatggatgggagtcaactgctcgtctttgtcgagaccaaggcgaacgtcgacgcgctgactcgccgccttcgcgtcgagggttggcccgcgctcggtcttcacggggccaaggaacaaaaagagcgcgattgggtgctgaaagaattcagagaggggaaatcgcccatcatgctcgccaccgacgtcgcatcgcgtggtttggacgtcgacgggatcaaactcgtcgtcaactacgactttcctaaaaacgtcgaggaatacgtccaccgaattggtcgcactggtcgcgcgggacgcgcgggcaaggcgcataccttcttcaccctcaacgacggtaaattagccagagaactcgtcgaggtcttgcgctcgacggggcagaaagttccggacgcgctctcgcgcttcgtctcgtag

SEQ ID NO: 59 - protein, 453 aa, Ostreococcus RCC809
MDASARGGDERRASTSEREDDDASRWLFEKNFYYEHPNVSARTLAEVEREMVRREIRVVRGVNVPKCVRTFEEASFPTYVNDDLAREAFAEPSAVQSQAWPIALSGRDLIALAETGSGKTLAYLLPAIVHVNAQPILESGEGPIALVLAPTRELACQIELEVAKYAASSELKHTCVYGGVPKGPQVKALRSGRSEICVATPGRLLDFLDGGQTNLRRTTFVVLDEADRMLDMGFEPQIRRIVQQTRPDRQTLLFTATWPVEVREAAREFVRNDPVEVRVGGTGDGLLASKNVEQIVHVMGPDEKYDALVSTLEKEMDGSQLLVFVETKANVDALTRRLRVEGWPALGLHGAKEQKERDWVLKEFREGKSPIMLATDVASRGLDVDGIKLVVNYDFPKNVEEYVHRIGRTGRAGRAGKAHTFFTLNDGKLARELVEVLRSTGQKVPDALSRFVS

SEQ ID NO: 60 - DNA, 1485 bp, Oryza sativa
atgagccgcttcgacggccgcgccgcggaccccggctcgtaccgcgaccgccgcagcgaaggggcgttcgggggcgggacgagggcgttcgccccgacgagcaaggcggactccgcggccgcggccgctgacctggatgggctgccgcggttcgagaagaacttctacgtggagtccccctccgtggccggcatgacggaggaggaggtggaggcctaccggcgccgccgggagatcaccgtggagggccgcgacgtgcccaagccagtgcgcgagttccgcgatgtcggattcccagaatatgttttgcaagaaattacaaaagctgggtttgtagaacctactcctatccagtctcaaggttggccaatggcactgaggggacgtgatcttattggcattgctgaaacaggatcagggaaaacacttgcttaccttttacctgccattgttcatgttaatgctcagccgattctagcacctggcgatggtccaattgttctggtgttagcccctacacgtgaacttgctgtgcagatacagcaagaggcaactaagtttggtgcgtcatcaaaaataaaaagtacttgcatatatggtggtgttccaaaaggtcctcaagttcgcgatcttcaaaaaggcgttgaaattgttatagccacgccaggaagactgattgatatgatagaatcacatcatacaaatttgcggagggtcacttaccttgttttagatgaggcagaccggatgctggatatgggctttgaacctcagattaagaaaattgtttctcagattcgtccagatcgccaaacattatattggagtgctacttggccaaaggaagttgaacagctagcaaggaactttcttttcgacccatacaaggtcataattggttctgaggagttgaaagctaatcatgccatttctcaacatgtggagatattatccgagagtcagaagtacaataagttggttaatctactggaggatataatggatggcagccggatattaatatttatggacacgaagaagggatgtgatcaaatcactagacagcttcggatggatggttggcctgctctgtctatccatggtgacaaaagccaagctgagagggattgggttctttctgaatttaaatcagggaaaagccctatcatgacagcgactgatgtggctgctcgaggcttagatgttaaggatgttaaatatgtcattaactatgactttccgggatcattggaggattatgttcatcgcattggtcgaactggcagagctggagcaaaaggaacagcttacacgtttttcactgctgctaatgccagatttgccaaggatctgatcaacatactagaagaagctggacaaaaggtcagccctgaattagctaatatgggtcgtggtgcaccacccccttcttcaggccaccgtgatagatatagagggtatggaggtggccggtcatggagctga

SEQ ID NO: 61 - protein, 494 aa, Oryza sativa
MSRFDGRAADPGSYRDRRSEGAFGGGTRAFAPTSKADSAAAAADLDGLPRFEKNFYVESPSVAGMTEEEVEAYRRRREITVEGRDVPKPVREFRDVGFPEYVLQEITKAGFVEPTPIQSQGWPMALRGRDLIGIAETGSGKTLAYLLPAIVHVNAQPILAPGDGPIVLVLAPTRELAVQIQQEATKFGASSKIKSTCIYGGVPKGPQVRDLQKGVEIVIATPGRLIDMIESHHTNLRRVTYLVLDEADRMLDMGFEPQIKKIVSQIRPDRQTLYWSATWPKEVEQLARNFLFDPYKVIIGSEELKANHAISQHVEILSESQKYNKLVNLLEDIMDGSRILIFMDTKKGCDQITRQLRMDGWPALSIHGDKSQAERDWVLSEFKSGKSPIMTATDVAARGLDVKDVKYVINYDFPGSLEDYVHRIGRTGRAGAKGTAYTFFTAANARFAKDLINILEEAGQKVSPELANMGRGAPPPSSGHRDRYRGYGGGRSWS

SEQ ID NO: 62 - DNA, 1590 bp, Phaeodactylum tricornutum
atgtcatattacggaggcggcagcggcggaggcggatatcgcgattcgggtggatacggtggaggtcccggagcaggaggcggtggctacggaggaggaggagcgtacggaggtgggggaggagcgtacggcgccggaggcggctacggcggtggaggaggaggtggctacggcggtccgcccatgggaggtggcggtgcctacggcagctccaacctcggtgctacgcttggatccattgactttagcaagacggagctcgtacagttcgaaaaagacttttatattgaacatcccgacgtgcgtgcccggagcgatcaggaagccgacgcctggcgggcttcgaaacaaatcgtggtgcgcggacacgatgtgcccaaacccgtcatgactttcgacgaagcttccatgccggaatacgtgctgaacgaagtgctcaagtgtggattcgacaagcccacgccgattcaaagccagggttggcccatggccttaaagggacgcaacatggtgggcgtgtccgccaccggatccggtaaaacgttggcgttcctcttgcccgccatgattcacatcaatgcccagccgtatttgaaaccaggtgatggtcccattgttctcgtgttggcccccacccgtgaattagccgtgcaaatcaaagaagaatgtgacaagtttggtagttcgtccgaaatcaaaaataccgttgtttacggtggagtcaaaaagcacacgcagcttcgcgagttgcgtgcgggagccgaaatttgcatcgccacgcccggacgtttgattgatcacttggagcagggcaacactaatctcaaacgcgtcacgtacctggtcttggacgaagctgatcgcatgttggatatggggttcgagcctcaattgcgcaagatcgtctcacagattcgtcccgatcgtcaggtgctcatgtggagcgcgacctggccaaaggaagtccaggccttggcgaacgactaccttcaagacttttaccaagtcacagtcggttctctggatctatcagccaacaaggatgtgacgcaaattattgaagtgtgcacggacatggacaagtatcgtaacctacagcgttatttgcgcgagaaccttagtcccaaagatcgtgtcctggtttttgtggaaacgaagaagggatgcgacatgctcacacgttccttgcgctctgacggttttcaagctcgtgccatgcacggagacaaatctcaggaagagcgtgattgggcgttgcgtgaattcaagggtatgcaaagtacacttctggtagctacggatgttgctgcgcgtggattggatgttgacgatatccgtattgtagtaaactttgattttcccaaggagatggatagctacattcaccgtgttggccgtaccggacgtgccggtaagaaaggtttcgcagtgtctttctttgtccccgacaagaacgctcgtctggccagggaactggttgatatcctcaaccgcacgtcccagaatgtccctcaggagctccaagccttgaccagcttttctggtggccgtggagggggagggcgtggtcgtggtggtcgacgctactag

SEQ ID NO: 63 - protein, 529 aa, Phaeodactylum tricornutum
MSYYGGGSGGGGYRDSGGYGGGPGAGGGGYGGGGAYGGGGGAYGAGGGYGGGGGGGYGGPPMGGGGAYGSSNLGATLGSIDFSKTELVQFEKDFYIEHPDVRARSDQEADAWRASKQIVVRGHDVPKPVMTFDEASMPEYVLNEVLKCGFDKPTPIQSQGWPMALKGRNMVGVSATGSGKTLAFLLPAMIHINAQPYLKPGDGPIVLVLAPTRELAVQIKEECDKFGSSSEIKNTVVYGGVKKHTQLRELRAGAEICIATPGRLIDHLEQGNTNLKRVTYLVLDEADRMLDMGFEPQLRKIVSQIRPDRQVLMWSATWPKEVQALANDYLQDFYQVTVGSLDLSANKDVTQIIEVCTDMDKYRNLQRYLRENLSPKDRVLVFVETKKGCDMLTRSLRSDGFQARAMHGDKSQEERDWALREFKGMQSTLLVATDVAARGLDVDDIRIVVNFDFPKEMDSYIHRVGRTGRAGKKGFAVSFFVPDKNARLARELVDILNRTSQNVPQELQALTSFSGGRGGGGRGRGGRRY

SEQ ID NO: 64 - DNA, 1737 bp, Sorghum bicolor
atgaacccctacgacctccgcttcgccgacccctcatcctaccacgacaggcgcagcgacctggccgtggctcctacgttcgctccgccggctcccgtggctgcggtgaacccgaacccttacgccgccgcctacccgcccgtgccagtgcccgtgcccgcggcccccgcgggcggcgactaccagcgctacgggcagggcggcagaggccgtggtggaggcggcagaggaggcggcggtgggtatggaggtggcggtggtgggtatggaggtggcggcaggggaggtggtcgcgggagggacgggcttgactcgcttgccctccctaagccggacttccggagcctgataccgttcgagaagaacttctacgtggagtgtccctccgtccaggctatgtcggaggcggatgtggcgcagtaccgccgcctccgggatatcaccgtagagggccgggatgtgcccaagccggtccgatacttccaggaagccaacttcccagattactgcatgcaagcgattgccaaatctggatttgtggagccaactcctattcaatctcaaggttggcctatggctttgaagggtagggacctgattggtatcgctcaaacaggctcagggaaaacattatcttatctgctacctgggttggttcatgttggtgcccagcctcggctagaacaaggcgatggcccaattgtattaatcctcgcccccacaagagaactggctgttcaaatacaggaagaatctacaaaatttggatcatattcaagaactagaagcacatgtgtctatggtggtgcacctaagggtccacaaatacgtgaccttagaagaggagttgaaattgtcattgcaactcctggtcggttgattgatatgctggaagccggccacacgaacctacgtagagtgacataccttgtgctggatgaggcagaccggatgctagatatgggttttgagccccaaattcgaaaaatagttgcacagatccgcccagacaggcaaacattgtactggagtgccacatggcctagagaagttgaagccttagcaaggcagtttctgcaaaatccttataaggtaaccataggatcacctgaacttaaagctaatcattccatacaacaaattgtagaagttatttcagaccatgagaagtatccaagactcagtaagctcttgtctgatctaatggacggaagccgtatcttgatattcttccaaacaaaaaaggactgcgataagatcacacggcaacttagaatggatgggtggccggcattatctatacatggtgataaagctcaagctgaacgggactatgttcttgcagagtttaagagcggcaagagtcccataatggctgctacagatgtggcagcacgtggtcttgacgtgaaggacataaagtgtgtgataaattatgattttccaacaactcttgaagattatattcacaggataggtcgaactggccgtgctggtgctagcggaactgcatttacttttttcacacatgcaaatgctaagttctcaaggaatctagtgaagattctgcgggaagctggacaagctgtgaatcctgcactagaatccatgtccaagtcttcaaactcagggggaggaggcaatttccggtcgagaggcagaggtgggtttggtaaccggggtcatatgtctggatcaaatacctttcctttaggaggagggagaaggccatattga

SEQ ID NO: 65 - protein, 578 aa, Sorghum bicolor
MNPYDLRFADPSSYHDRRSDLAVAPTFAPPAPVAAVNPNPYAAAYPPVPVPVPAAPAGGDYQRYGQGGRGRGGGGRGGGGGYGGGGGGYGGGGRGGGRGRDGLDSLALPKPDFRSLIPFEKNFYVECPSVQAMSEADVAQYRRLRDITVEGRDVPKPVRYFQEANFPDYCMQAIAKSGFVEPTPIQSQGWPMALKGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDMLEAGHTNLRRVTYLVLDEADRMLDMGFEPQIRKIVAQIRPDRQTLYWSATWPREVEALARQFLQNPYKVTIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLDVKDIKCVINYDFPTTLEDYIHRIGRTGRAGASGTAFTFFTHANAKFSRNLVKILREAGQAVNPALESMSKSSNSGGGGNFRSRGRGGFGNRGHMSGSNTFPLGGGRRPY

SEQ ID NO: 66 - DNA, 1857 bp, Arabidopsis thaliana
atggctgctaccgctgctgcttctgttgtccgttacgcacctgaggatcatactcttcccaagccctggaaaggccttatcgatgatagaactggttacttgtacttttggaatcctgagaccaatgttactcagtacgagaaaccaaccccctctctacctcctaagttttctcccgccgtttctgttagctcttccgttcaggttcaacaaactgatgcctatgctcctcccaaggatgacgataagtactccagaggctctgaacgtgtgtccaggttttctgagggtggcaggagtggaccgccttattcgaacggtgctgctaatggagttggggattctgcttatggtgcagcatctaccagagttcctcttccttcatcagctccagcaagtgaactatcccctgaggcctattcccgccgtcatgaaattactgtcagtgggggccaagtaccaccacctctaatgtcctttgaagctactggttttccacctgagcttctgcgggaggtactcagtgcaggtttctctgctccaactccaattcaagctcagtcatggcccattgctatgcaaggtagggacatagtagccattgctaaaactggctcgggaaaaactttgggttacttgattcctggatttttgcatcttcaacgtatccgaaatgattcgcgaatgggcccaacaatcttggtattgtctccaacgagagagctggccacacaaatccaagaagaagctgttaaatttgggaggtcatcaagaatttcgtgtacgtgtttgtatggtggtgcaccaaagggccctcagttgagggatttagaaagaggagcagatatcgtggttgcaactcctgggagattgaatgatatccttgaaatgaggaggattagtctgcgtcagatatcttatcttgtgctagatgaggcagatagaatgttggacatgggttttgaacctcagataaggaagattgtgaaagaaattcccactaagcgtcaaacccttatgtacacagctacatggccaaagggagttaggaaaattgcagctgacttgcttgttaaccctgctcaagtcaacattggcaatgttgacgagcttgtggctaacaagtcaatcacacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacagaagcagcaatggatggggaagagagcgagaaaggagccgtagccctgagagattcaacagagctccaccaccgtcttccaccggatctcctcctcgcagcttccacgagacgatgatgatgaaacacagatga

SEQ ID NO: 67 - protein, 618 aa, Arabidopsis thaliana
MAATAAASVVRYAPEDHTLPKPWKGLIDDRTGYLYFWNPETNVTQYEKPTPSLPPKFSPAVSVSSSVQVQQTDAYAPPKDDDKYSRGSERVSRFSEGGRSGPPYSNGAANGVGDSAYGAASTRVPLPSSAPASELSPEAYSRRHEITVSGGQVPPPLMSFEATGFPPELLREVLSAGFSAPTPIQAQSWPIAMQGRDIVAIAKTGSGKTLGYLIPGFLHLQRIRNDSRMGPTILVLSPTRELATQIQEEAVKFGRSSRISCTCLYGGAPKGPQLRDLERGADIVVATPGRLNDILEMRRISLRQISYLVLDEADRMLDMGFEPQIRKIVKEIPTKRQTLMYTATWPKGVRKIAADLLVNPAQVNIGNVDELVANKSITQHIEVVAPMEKQRRLEQILRSQEPGSKVIIFCSTKRMCDQLTRNLTRQFGAAAIHGDKSQPERDNVLNQFRSGRTPVLVATDVAARGLDVKDIRAVVNYDFPNGVEDYVHRIGRTGRAGATGQAFTFFGDQDSKHASDLIKILEGANQRVPPQIREMATRGGGGMNKFSRWGPPSGGRGRGGDSGYGGRGSFASRDRSSNGWGRERERSRSPERFNRAPPPSSTGSPPRSFHETMMMKHR

SEQ ID NO: 68 - DNA, 3267 bp, Arabidopsis thaliana
atggccacaacagaagatactccagcttctgctggtccaagatatgctccagaggacccaactcttccccaaccatggaagggacttattgatggaagcacaggaattctctattactggaatcctgaaaccaatgtcactcagtatgaaagaccttctgcgcctcctccccactctgccacaacaccgaagctagctcagattcctgtaccctcttcaggacaaggtcaccaagctcagcatgaacaagcaaaaccagttggtcatgtgtctcagcagcatggtttccaacaacagccacagcaatttccatcccaacatgtaagaccccaaatgatgcagcagcatccggcccagcaaatgcctcaacaatcaggtcaacagtttccccaacaacagagccaatcgatggtgccgcacccacatgggcatccttctgtacagacttatcagccaacgacgcagcagcagcagcaagggatgcagaatcagcattcacaaatgcctcagcagctgagccatcagtatgctcattcacaacaacattacatgggttttcggcctcacatgcaaacgcaaggacttcaaaattcacatcagacacctcagggtggtccccatggtcagcagtttccgagccagcaagagtacaactcattggctccgaagagggagggggatgagttccatgggggtaagaaaactgggttttctcaaccccatttaccaaattctgaacgttcaccatctcaaaatacccactttgaagccaatgcagcatcacaaaagacgaatgcaaacttggctatggctcagaaatgcaatggacctcaagcaaatgctgcagtcacacagtttcaacagccaggggcgaacctaattcaccagcaacttggacctagggcgccaaatcaaatggaccagacaatgttgcaccagaagtctcacgtttcccctttccaatcaaataatacttatgagaataatctacaatctaggcctggtaatgactcgtacgttaacatgagaatggaagtgccggttaggggtgcccaaccacttcatcctgcagcaatgcctaaggatataaggataagtggtggtccaccaacaaatgctgatcccgccatggggcaaacagggcatggaacatatggacacgctggtccagcttttccaaataaatccttggtgcggcctcattttgtcacatctcctgatgttccccatctctctcccgttgaaatataccgaaaacaacatgaagtcacaacaactggcgagaacattccagcaccatacatcacatttgaatctagtggtctcccacctgaaatccttagagagttgctttctgctggatttccatcgccaacaccgatccaggcccaaacatggccaattgctctgcaaagcagggatatagttgcaattgcaaaaactggttctggtaaaacattgggatacttgatccctgccttcattcttctaaggcactgtcgtaacgactcccgcaatggccccacagttttgatcctagctcctactcgggagctagccacacaaatacaagacgaagcactaaggtttggacggtcttccaggatatcatgcacttgtttgtatggtggagctccaaagggtcctcaattgaaagagttggaacgaggagctgatattgtggtggcaactcctgggcgtctaaatgatatactggagatgaagatgattgatttccagcaggtttcccttcttgtgcttgacgaggcagaccgaatgcttgacatgggttttgaaccccaaatccgtaagattgtgaatgaaatacctcctcggagacagactcttatgtacacagccacttggccaaaagaagtaagaaaaattgcaagcgatcttcttgtgaaccctgtccaagttaacataggcagggtagatgagttggctgctaacaaagcaataacgcagtatgttgaagtagtcccacaaatggagaaagagagacgtttggagcaaatccttaggtcacaagaacgaggttcaaaagttataatattttgctccacgaagaggctttgtgaccatcttgcacgtagtgtcggacgtcattttggcgctgttgtgatccatggagacaagactcaaggtgagagagattgggtgcttaaccagttccgaagcgggaagtcttgtgtactgatagctactgacgttgctgcccggggactcgacataaaagacatacgagttgtgatcaactacgattttccaactggagttgaagactatgtccaccgtattgggagaaccggtcgagctggtgcaactggagttgcattcactttctttacagagcaagattggaaatacgcacctgatttgatcaaagtcctggaaggagcgaaccagcaagtaccgcctcaagtaagagatattgcaatgcgtggtggtggtggtggtggtcccggttatagccaggatcgaagaggtatggttaaccggtttgactctggcggtggtggtacccgttgggattctggtggtgggtttggtgggcgtggtggtgggtttagtggccgtgagggtgggtttggaggccgtgagggtggatttgggggccgtgagggtggatttggaggccgtgggggaagatttggaatgagagatgactcatttggacgtggcgggaatcgtggtcggggttttactggtcctgatgctggtcatatgaatgtgggtggtagaggcggatttggtcggtttggcaataataataatatggagagccgaggctttggtcgtggtagtggtagaggctttggtcgtggtgttggacggtttgacaacagaagaggtagaagtcgcagcagaagtcctgatttggttcggccacggcgccgtagctcgagctatagccggagtcgaagccggagcgggagctatagtcgtagccgtagccgtagcaggagctggtcacgttcaaggagtcgcagccctagacatagccgtgaccgaggtggtcataacaggagcagaagctatagccgtagtcctagtccggtttatgaaagacgagatagagcgccacgtgtttctgggtttgatattaaaccaccagttgaatctgtagtgaacctggacatgaatgccgcggcagcgattgaaaacgtggttcctacatccttgtctgagagacaagggaatggggttgttgaatcggaggtagaagcggctttagtacgaccagtggttgatgaagaaccctaa

SEQ ID NO: 69 - protein, 1088 aa, Arabidopsis thaliana
MATTEDTPASAGPRYAPEDPTLPQPWKGLIDGSTGILYYWNPETNVTQYERPSAPPPHSATTPKLAQIPVPSSGQGHQAQHEQAKPVGHVSQQHGFQQQPQQFPSQHVRPQMMQQHPAQQMPQQSGQQFPQQQSQSMVPHPHGHPSVQTYQPTTQQQQQGMQNQHSQMPQQLSHQYAHSQQHYMGFRPHMQTQGLQNSHQTPQGGPHGQQFPSQQEYNSLAPKREGDEFHGGKKTGFSQPHLPNSERSPSQNTHFEANAASQKTNANLAMAQKCNGPQANAAVTQFQQPGANLIHQQLGPRAPNQMDQTMLHQKSHVSPFQSNNTYENNLQSRPGNDSYVNMRMEVPVRGAQPLHPAAMPKDIRISGGPPTNADPAMGQTGHGTYGHAGPAFPNKSLVRPHFVTSPDVPHLSPVEIYRKQHEVTTTGENIPAPYITFESSGLPPEILRELLSAGFPSPTPIQAQTWPIALQSRDIVAIAKTGSGKTLGYLIPAFILLRHCRNDSRNGPTVLILAPTRELATQIQDEALRFGRSSRISCTCLYGGAPKGPQLKELERGADIVVATPGRLNDILEMKMIDFQQVSLLVLDEADRMLDMGFEPQIRKIVNEIPPRRQTLMYTATWPKEVRKIASDLLVNPVQVNIGRVDELAANKAITQYVEVVPQMEKERRLEQILRSQERGSKVIIFCSTKRLCDHLARSVGRHFGAVVIHGDKTQGERDWVLNQFRSGKSCVLIATDVAARGLDIKDIRVVINYDFPTGVEDYVHRIGRTGRAGATGVAFTFFTEQDWKYAPDLIKVLEGANQQVPPQVRDIAMRGGGGGGPGYSQDRRGMVNRFDSGGGGTRWDSGGGFGGRGGGFSGREGGFGGREGGFGGREGGFGGRGGRFGMRDDSFGRGGNRGRGFTGPDAGHMNVGGRGGFGRFGNNNNMESRGFGRGSGRGFGRGVGRFDNRRGRSRSRSPDLVRPRRRSSSYSRSRSRSGSYSRSRSRSRSWSRSRSRSPRHSRDRGGHNRSRSYSRSPSPVYERRDRAPRVSGFDIKPPVESVVNLDMNAAAAIENVVPTSLSERQGNGVVESEVEAALVRPVVDEEP

SEQ ID NO: 70 - DNA, 1908 bp, Brassica napus
atggccgctaccgctccttccgcagtccgttatgctcccgaggatcattctcttcccaagccgtggaagggacttgttgatgatcgaactggatacttgtacttctggaatcccgagaccaacgttactcaatacgagcgacctcaacctcctcccaacttacctgtaagctcctccgcctccgttcaggttcctcaagcctctgccgtaccaaatggtagtagctatgctcctgccaagggtggtgatgataagtacactagagccagtgacggtgggcctaggcgctcgaggtttagtgagattgatgacaggagtggagcgccgtatttgaatggggctgccaatggacttgggaactctcttcctccttcatcagctccagttagtgatatttctccggaggcctattgccgccgtcatgaaattactgtcagcggggggcaagtaccagcacctctaatgtcctttgaaactactggttttcctcctgagcttctgcgcgaggtactcaatgcaggtttctctgctccaactccaattcaagctcagtcgtggccaattgcgatgcaaggtagggacatagttgccattgctaaaactggctcgggaaaaactttgggttacttacttcctggatttatgcatcttcaacgcgtccggaatgattcgcgaatgggcccaacaatcttggtactgtctccaaccagggagcttgccacacaaatccaagacgaagctgttaaatttgggaggtcgtcaagaatttcgtgcacatgcttgtatggtggtgcaccgaagggtccccagctgagggatttggaaagaggagctgatatcgtggttgcaactcctggacggttgaatgacatccttgagatgagaagaattagtctgcgtcaagtatcttatcttgtgctagatgaggcagatagaatgttggacatgggtttcgaaccgcaaataaggaagattgtgaaagagattcctactaagcgccaaacacttatgtacacagctacatggccaaagggagtcaggaagattgcagcggacttgcttgttaaccctgctcaggtcaacattggtaacgtcgacgagcttgtggctaacaagtcgatcacacagcacattgaagtggtagcaccaatggagaaacagaggaggttagagcagatattgaggtctcaggaacctggctcgaaggtgataatattctgctcaaccaaaaggatgtgcgaccagctaactcgcaatctgacccgccaatttggagctgctgccatacatggagacaagtcacagcctgagagagacaatgttctgaatcaatttcgcagtggcaggactccggttcttgttgcaactgatgttgctgctcgtgggctggacgttaaggacatcagggcggtcataaactatgatttccccaatggagtggaagactatgtgcatagaatcggaagaacaggaagagctggagcgactggtcaggcattcacattctttggcgatcaagactcgaaacatgcttcggatctaatcaagatcttggaaggagcaaaccagcgagttcctcctcagatccgcgatatggctgcacgtggtggcggtggaatgaacaaattcagccgttggggtccaccttccggaggtcgaggtggcggctctggttatggtggcagaggtggcggctctggttatggtggcagaggtagcgactctggttatggtggcagaggtggctttgattcacgtgacagtggaatgggaagtagaagcagcaatggatggggaagagagcgtgaaaggagtcgtagcccggagagattcaacagagttccaccaccgtcttctactggatctcctcctcgcagcttccatgaagccatgatgaaacaccgataa

SEQ ID NO: 71 - protein, 635 aa, Brassica napus
MAATAPSAVRYAPEDHSLPKPWKGLVDDRTGYLYFWNPETNVTQYERPQPPPNLPVSSSASVQVPQASAVPNGSSYAPAKGGDDKYTRASDGGPRRSRFSEIDDRSGAPYLNGAANGLGNSLPPSSAPVSDISPEAYCRRHEITVSGGQVPAPLMSFETTGFPPELLREVLNAGFSAPTPIQAQSWPIAMQGRDIVAIAKTGSGKTLGYLLPGFMHLQRVRNDSRMGPTILVLSPTRELATQIQDEAVKFGRSSRISCTCLYGGAPKGPQLRDLERGADIVVATPGRLNDILEMRRISLRQVSYLVLDEADRMLDMGFEPQIRKIVKEIPTKRQTLMYTATWPKGVRKIAADLLVNPAQVNIGNVDELVANKSITQHIEVVAPMEKQRRLEQILRSQEPGSKVIIFCSTKRMCDQLTRNLTRQFGAAAIHGDKSQPERDNVLNQFRSGRTPVLVATDVAARGLDVKDIRAVINYDFPNGVEDYVHRIGRTGRAGATGQAFTFFGDQDSKHASDLIKILEGANQRVPPQIRDMAARGGGGMNKFSRWGPPSGGRGGGSGYGGRGGGSGYGGRGSDSGYGGRGGFDSRDSGMGSRSSNGWGRERERSRSPERFNRVPPPSSTGSPPRSFHEAMMKHR

SEQ ID NO: 72 - DNA, 1950 bp, Emiliania huxleyi
atgtggaacaccgcgctcgacggcgcagggcacacctactattggcactctgagacgggcgcgtcgcagtacgagaagcccgccgactttgaccccgccaaggcgcagaactcgggctcgtacacccaataccaaaacggcagcggcggcggaggaggaggtggcggaggagggtatggcggcggtggcggcggcggcgggtacggcggcggcggcggcgggtacggcggcggcgggtacggcggcggcggcggcggctacgaccgcgacgccatcgggctccagttctcgcgccccgccaacacaaactacaaggacgtgcaggaccaaggcttctggaaggagaacgacctcaaggtgtacggcggctcgccgccgccgttcctctccttcgaggaggcgcagctgccgcggccgatcatggacgccatcgccaaggccggcttcaccaagccctccgtcatccagtcccagtcgtggcccgcggcgatggccaagcgcgacttgattggcgtcgccaagaccggctcgggcaagacgctcggcttcctcgtgccgggtttcatgtacatccagcagcagcgcgtcaacccgatgcagggaccgtccctgctcacgctggcgccgacgcgcgagctcgccatgcagatcgaggtcgagtgccaaaagtttgggctgccgctcgggatccggtccgtctgctgctacggcggcgcgcccaaggggcagcagctgatggcgatgcggcaggggtgccacgtggtaatcggcacgccggggcggatcaacgacttcctcgagtcgggccagatccagctgcaccaggtcgcctaccttgtgtttgacgaggcggaccggatgctcgacatgggctttgagccgcagatccgcaagattgtgcgccaagtgccgccgcagcggcagacgctcttctacacggccacgtggccaaagcaggtgcgcgcgctggcctacgagttcatgcggtcgcctgtgcaggtcgaggtgggcgacatcaactcgctcaacgcaaacaaggacatcacgcagtacgtgcacgtgacgcgcgggccgggcgagaagcagcagatgctcatgcgcatcttccagtcgctcgaggcgggcacgcgcacgctggtcttcacgtcgaccaagcggatggcggaccagctgggcatgcagctcggccgccagatcggcagcggcgtcatccacggcgacaaggaccagcgcgagcgcgaggctgtcctcgccgacttcaagagcggccgccggccagtgatgatcgcgaccgacgtggccgcgcgcggcatcgacgtcaaggagtgcaaggccgtcatcaactacgacttcccgggcaatattgaggactatgtccaccgcatcggccgcaccggccgcgccggcgccaagggggaggcgcacaccttcatggacgggcaaaaggacggcaagtacgcgcgcgcgctgtgcgagatcatggtcaaggcggaccaggcgatcccggggccaatcgcgcagatggcaggcctgcgcagcgggacgtaccgccccgccgtgctgcaccgcggcggcggcggcggcggcggcagcggcggcggcggcggcggcggcggcggcggcggcggcggcggcggcggtggaagcactcgtgcaagcaaccggccgatggaacgcgcgacgggcgatgcgggcaaacgatcggcggctgatcgcactcgtcgatcgaagtcgcccgagcagcatctcgccaccgtttcgggggcagcgagtatttttctttctctggttaccgacgcgtccaccgataccgcgttggtgtccagtccgagcctggctgttcttcacctttctacctacctacctaccgacaagggagaaagcacggggaggacagaccacgcctcactttctcacaggggggggagccaggcaaagcttgtgctgtga

SEQ ID NO: 73 - protein, 649 aa, Emiliania huxleyi
MWNTALDGAGHTYYWHSETGASQYEKPADFDPAKAQNSGSYTQYQNGSGGGGGGGGGGYGGGGGGGGYGGGGGGYGGGGYGGGGGGYDRDAIGLQFSRPANTNYKDVQDQGFWKENDLKVYGGSPPPFLSFEEAQLPRPIMDAIAKAGFTKPSVIQSQSWPAAMAKRDLIGVAKTGSGKTLGFLVPGFMYIQQQRVNPMQGPSLLTLAPTRELAMQIEVECQKFGLPLGIRSVCCYGGAPKGQQLMAMRQGCHVVIGTPGRINDFLESGQIQLHQVAYLVFDEADRMLDMGFEPQIRKIVRQVPPQRQTLFYTATWPKQVRALAYEFMRSPVQVEVGDINSLNANKDITQYVHVTRGPGEKQQMLMRIFQSLEAGTRTLVFTSTKRMADQLGMQLGRQIGSGVIHGDKDQREREAVLADFKSGRRPVMIATDVAARGIDVKECKAVINYDFPGNIEDYVHRIGRTGRAGAKGEAHTFMDGQKDGKYARALCEIMVKADQAIPGPIAQMAGLRSGTYRPAVLHRGGGGGGGSGGGGGGGGGGGGGGGGGSTRASNRPMERATGDAGKRSAADRTRRSKSPEQHLATVSGAASIFLSLVTDASTDTALVSSPSLAVLHLSTYLPTDKGESTGRTDHASLSHRGGSQAKLVL

SEQ ID NO: 74 - DNA, 2331 bp, Glycine max
atggctgccacagcaactgtgtctttgatgggtccgaggtatgcaccaccagacccaacactccctaaaccatggcggggtcttgtggatggcaagactgggtatctttacttttggaatcctgagactaatgtcacccagtatgagaggccatcctcaagctcagcttcccagtcaaagttttcttcagtgcccagctcttctgtccaggttcaacaatcatctcaagggtcgcaacgtggtcgtagtcctgatttcagtgataggtatgatcgaaatggcactggtgggtcaaacgacgctggatcccggaacaatcagagttccaaagggggaagttatacttctcatgatgtttcaaatggaacaaatgttgctggcaatggtaattcttctgtcagaggtcatggggcttcagatgctggagctggactatctgctgagtcttatcgacatcggcatgaaatatctgtgactggagacaatgtgcctccaccgcttgcatcatttgggtcaactggctttccatctgagcttctgagagaggtacaaaatgctgggttctcagccccaactccaattcaggcacagtcatggcccattgctcttcaaggtagagatatagttgccattgctaaaacaggctcagggaaaaccttgggatatttaattccagcatttattcacctcaagcgctctggtaataactccaaaatgggccccactgcattggtactttcaccaacaagggagttggcaacacagatacaagatgaagccatgaagtttgggaaatcatctagaatttcatgtgcatgtttgtatggaggagcaccaaagggtcctcaactgagagacattgatcgtggagcagatattgtggtagccactcctggtcgcttgaatgatattcttgagatgagaagaattagtcttaatcaggtttcttacctggtgctagatgaggcagacaggatgctggatatgggttttgaacctcaaattaggaaaattgtgaatgaggtgcccaatcgcaggcaaactctaatgtttactgcaacatggccaaaggaggttaggaaaattgcagctgatctgctagtcaagcctgtccaggtgaacattgggaatgtagatgagcttgttgctaacaagtctattactcagcatgttgaagtattgccaccaatggagaaacaaagacggctggaacatattttgcggtcacaggatcaaggatcaaagataattattttttgttctaccaagaaaatgtgtgatcaacttgctcgtaatctgacacgtcatttcggagctgctgctattcatggggataaatcccaggctgagagggatcatgtgttgagtcagtttcgaactgggaggtctcctgtgctagtggccacagatgttgctgctcggggactggatatcaaggacattagggtggttgtcaattatgacttccctacaggagtggaagattatgttcataggattggaaggactggaagagctggagccactgggctagcttacactttctttggtgaccaggatgctaaatatgcttcagatctcatcaaagtcttggaaggtgcaaaccagaaggtacctccagaacttcgtgatatgtcatcacggagtggtggtgggatgggtagatccagacgatggggttctgggggacgaggtggacatggtgattctggatatggtggaaggaataatgactctggatatggtggaagaggtaatgatgcaggatatggtggaagaggcagtgattctaattatggagggagggggactgctgcttctggcagaggtggaggccgtgggtttgaccatgactcccagaggaatgataggggtcggagcccagacaagggatctagttggagtgatcgcttcaaaagcgtcaaccgggatcgcagtcgtagtcctgacagggctgcactacctcaacattcccaaggtggcagctttcacaaggcaatgatggaacgtggtggtggtggtggtgatcgcaataagagctttaaccgggaccgaagccgcagtcctagccctcatagacaggagaagtgcccagcggttcgagatcgttccccagtttacagttttcatcaatcaatgatgggacgaggtcagtcatccccttcatctcaacggcagcgtgcacgcagtcctcaccgaaactcacccccctcccagggtgatggaagatatgctggatctcattcatcttacaatggagaagtggaggaagggatgattcccgaggaagaaggaatgattggtcaagatgatcccgtaaatgtcaattag

SEQ ID NO: 75 - protein, 776 aa, Glycine max
MAATATVSLMGPRYAPPDPTLPKPWRGLVDGKTGYLYFWNPETNVTQYERPSSSSASQSKFSSVPSSSVQVQQSSQGSQRGRSPDFSDRYDRNGTGGSNDAGSRNNQSSKGGSYTSHDVSNGTNVAGNGNSSVRGHGASDAGAGLSAESYRHRHEISVTGDNVPPPLASFGSTGFPSELLREVQNAGFSAPTPIQAQSWPIALQGRDIVAIAKTGSGKTLGYLIPAFIHLKRSGNNSKMGPTALVLSPTRELATQIQDEAMKFGKSSRISCACLYGGAPKGPQLRDIDRGADIVVATPGRLNDILEMRRISLNQVSYLVLDEADRMLDMGFEPQIRKIVNEVPNRRQTLMFTATWPKEVRKIAADLLVKPVQVNIGNVDELVANKSITQHVEVLPPMEKQRRLEHILRSQDQGSKIIIFCSTKKMCDQLARNLTRHFGAAAIHGDKSQAERDHVLSQFRTGRSPVLVATDVAARGLDIKDIRVVVNYDFPTGVEDYVHRIGRTGRAGATGLAYTFFGDQDAKYASDLIKVLEGANQKVPPELRDMSSRSGGGMGRSRRWGSGGRGGHGDSGYGGRNNDSGYGGRGNDAGYGGRGSDSNYGGRGTAASGRGGGRGFDHDSQRNDRGRSPDKGSSWSDRFKSVNRDRSRSPDRAALPQHSQGGSFHKAMMERGGGGGDRNKSFNRDRSRSPSPHRQEKCPAVRDRSPVYSFHQSMMGRGQSSPSSQRQRARSPHRNSPPSQGDGRYAGSHSSYNGEVEEGMIPEEEGMIGQDDPVNVN

SEQ ID NO: 76 - DNA, 1950 bp, Hordeum vulgare
atggcgtccgcggcgccgcgctacgcgccggaagatccgacgctgcccaagccctggaggggcctcatcgatggcaccaccggctacctctacttctggaacccggagaccaaggccgtcacctacgaccgccccaccggccctcctccccccgtcgcccccgccccggccccggcccccgcccccgctcccgtccagcagccccagtaccaccacgacgagagggccaggcacagagacccgcccgagcggcacactgaatctgccggaaaccgcatgcagaatgcgccctttgctgatcacaaggccaggaacgatccttcttttgagcagcgcccttcagctggagtaaatcctgcccccatgccttctactaacccagctccgcaggctgccaatggaaacatgtcggtagatgcataccgtaaaaagcacgagattactattatttgcccgggaagggaagctccaccgccattcatgtcgtttcagtccactggcttcccatcggagattctaagggaggtgcagcaagcaggattctctgcaccaagtcctatccaagctcaatcgtggccgattgctctaaaaggtagtgatattgtagctgtggcgaagacaggttctggaaaaaccctgggttatctactcccagggtttatacttgttaagaacctacgacacaattcaagggacgggccaaccgtgttagttctgtctccaactagggaattggcaacacagattcaagatgaagcaatcaagtttggtagatcatcaagaatttcatctacttgtctatatggtggtgctccaaaaggccctcagctaagagatttagagcgtggtgctgacattgttgttgcaactcctggaagactgaatgatattctagaaatgggaaaagtgagcctgcgtcaagtagcatatcttgttcttgatgaagctgaccgaatgcttgatatgggttttgagccacaaataagaaaaattgtgaaacaagtgcaacctaaacgacaaactcttatgttcactgccacttggcccagagaggtgaggaaaatagcttcagatttgctcactaaccctgtccaggttaacattgggaacactgatgagctggttgcaaataagtcaatcactcagtatgtggaagttaccacatctatggagaaagggaggcgtcttgatcagatcttgagacaacaggagcctggatcgaaggtcattatattttgctccacgaagaggatgtgtgatcagctgtctcgaaacctatcacggcagtatggtgcttctgctattcatggtgataaatcacaggctgagagggactctgtgttgagtgaatttcgaactggcaggtgcccaattcttgtagccactgatgtggccgctcgaggtttggatgtaaaggatatcagagttgttgttaactatgatttcccaacgggcgttgaggactatgtccatagaattgggaggacaggccgggctggtgcgtctggaattgcatacacattcttctgtgatcaggattctaagtatgcttcagatcttgtgaagattttggagggtgcgaaccaagctgtttcaccggagttacgagctatggtcggccgtggagggtatggtggcagggggccacggcggtgggcatcttctaatgattcctatggtggccacggagcttatggcagccagactagggatggcccaagctttcagtcaagcttcaataacagcagcagtggcaatcagtatggtggcgctccaagcttcaccagcagtaacaacaatcagaccagtgtcgctgcaaatttacctgtcagtggcagctctggtgaaggtctcagctttcatgctaggttctatagctcttcttcccgtggtggtgatcgtgctaggagcaggagccctcccaaggccgtgggggtttccaattggtaa

SEQ ID NO: 77 - protein, 649 aa, Hordeum vulgare
MASAAPRYAPEDPTLPKPWRGLIDGTTGYLYFWNPETKAVTYDRPTGPPPPVAPAPAPAPAPAPVQQPQYHHDERARHRDPPERHTESAGNRMQNAPFADHKARNDPSFEQRPSAGVNPAPMPSTNPAPQAANGNMSVDAYRKKHEITIICPGREAPPPFMSFQSTGFPSEILREVQQAGFSAPSPIQAQSWPIALKGSDIVAVAKTGSGKTLGYLLPGFILVKNLRHNSRDGPTVLVLSPTRELATQIQDEAIKFGRSSRISSTCLYGGAPKGPQLRDLERGADIVVATPGRLNDILEMGKVSLRQVAYLVLDEADRMLDMGFEPQIRKIVKQVQPKRQTLMFTATWPREVRKIASDLLTNPVQVNIGNTDELVANKSITQYVEVTTSMEKGRRLDQILRQQEPGSKVIIFCSTKRMCDQLSRNLSRQYGASAIHGDKSQAERDSVLSEFRTGRCPILVATDVAARGLDVKDIRVVVNYDFPTGVEDYVHRIGRTGRAGASGIAYTFFCDQDSKYASDLVKILEGANQAVSPELRAMVGRGGYGGRGPRRWASSNDSYGGHGAYGSQTRDGPSFQSSFNNSSSGNQYGGAPSFTSSNNNQTSVAANLPVSGSSGEGLSFHARFYSSSSRGGDRARSRSPPKAVGVSNW

SEQ ID NO: 78 - DNA, 1845 bp, Ostreococcus RCC809
atggtgcagggcacggtgagctcggtgggattacccccgggttggcaggaggttcgcgcggagggtaaggtgtattactggcacccggcgacgaacgtgacgcagtacgagcgaccgacggaggagacgaaggctgagaataagtttggatatctcggaaacacgggggcgtcgtttaatcatctcggcgcggatgatgcgtacggagcggaggagtacgaagcgccgcctccggacgcgtacagtaaagggaaaggtctggggacgaaggatctcgggtacggggcgacggagagtggagaggatttccgaaaaagacacgagattagcgtgcgcgcgccgccgggggtgacgactccggatccgatgatggcgttcgatgcggggccttggccgaaaccgctgttggatgcggtgaaacgggcgggatacagcgaaccgacggcgattcaggcgcagtcttggccgatcgcgttgcaagggtacgatatgatctcggtggcgaagacggggagcgggaagacggtggcgtttttgtttccgggtttgatgcacatcgccgagcgtgggaacggacgcaacgcccgaggtccgacgatgttggcgctcgcgccgactcgcgagctcgcgacgcagattcaagaggaatgcatgaagtttggttcgtcgtgcggcgtcggctcggtgtgcctgtacgggggcgcgcccaagggtcgtcaattggcgcaacttcgcaaccgaccgcaaatttgcatcgccaccccgggtcgtttgaacgatttattggagagccgcatgatcgacatgtctacggcgacgtatgtcgtcctcgacgaggctgatcgcatgttggatatgggtttcgagccgcaaattcgtaagattcttcaacacgttccggtggatcgtcaaacgctcttcttcaccgcgacgtggcccaaggctgtgattcgcgtcgcgacggccatcctgactaacccgatccaggtgaacatcggcgaaaccgatcaactcgtggccaacaaggacattacgcaaaacattgaaatcctcagcggcttcgacaaggagaagcgcctgatggaaatcttgaacagccctccggaaggctgcgatccgctcaaggcgctcgtcttctgctccacgaaacgcatgtgcgatcaaattggtcgctccatcggtaacttggctggcgtcattcacggcgacaaggaacagcgagaacgcgactggatcttgaaccagttccgtcaaggccgcacgccggtcctcgtcgccactgacgtcgccgcgcgcggtttggacgtcaaggattgcaacttggtcattaactacgacttcccgaaccaaatcgaagattacgtgcaccgcatcggccgtaccggtcgcgccggtaagaagggttgggcgtactcgttcatcgacggcggcgaaggcaacatggctcgcaagctcattccgattctccgcgacgccaaccaagtcgtgccgcacgagatcgaagagatggcccgatcctctggattcggtcgctccaagagcggtcgcagaggcggcggcggtcgcagaggcggcggcggcggcggctacggcggcggcggcggctacggcggcggcggcggctacggcggcggcggcggctacggcggcggcggtggctacggcggcggcggtggctacggcggcggcggtggctacggcggcggcggtaacggtggctacggcggcggcggtggctacggcggcgggggaggtccgcaacgaggcggacgctcctacggtggcggcggagggtacggctccgccggcggtggctacggcggtggcggtggttggaatcgatag

SEQ ID NO: 79 - protein, 614 aa, Ostreococcus RCC809
MVQGTVSSVGLPPGWQEVRAEGKVYYWHPATNVTQYERPTEETKAENKFGYLGNTGASFNHLGADDAYGAEEYEAPPPDAYSKGKGLGTKDLGYGATESGEDFRKRHEISVRAPPGVTTPDPMMAFDAGPWPKPLLDAVKRAGYSEPTAIQAQSWPIALQGYDMISVAKTGSGKTVAFLFPGLMHIAERGNGRNARGPTMLALAPTRELATQIQEECMKFGSSCGVGSVCLYGGAPKGRQLAQLRNRPQICIATPGRLNDLLESRMIDMSTATYVVLDEADRMLDMGFEPQIRKILQHVPVDRQTLFFTATWPKAVIRVATAILTNPIQVNIGETDQLVANKDITQNIEILSGFDKEKRLMEILNSPPEGCDPLKALVFCSTKRMCDQIGRSIGNLAGVIHGDKEQRERDWILNQFRQGRTPVLVATDVAARGLDVKDCNLVINYDFPNQIEDYVHRIGRTGRAGKKGWAYSFIDGGEGNMARKLIPILRDANQVVPHEIEEMARSSGFGRSKSGRRGGGGRRGGGGGGYGGGGGYGGGGGYGGGGGYGGGGGYGGGGGYGGGGGYGGGGNGGYGGGGGYGGGGGPQRGGRSYGGGGGYGSAGGGYGGGGGWNR

SEQ ID NO: 80 - DNA, 2280 bp, Oryza sativa
atggcgtcggcggcggcggcggcggcgacggcgagggggccgcggtacgcgccgccagatccgacgctgcccaagccgtggagggggctcatcgacggcaacaccgggtacctctacttctggaacccggagaccaaggccgtgcagtacgaccgccccacggcgccgccgccctcctcccccccggcgcagcagcctccggagaggcctaggaacagcgatcctgctgagtcgcaggcgcaggctggagcgagccgaacgcagaatgctgctcctgctgatgatagggcaaggaatgatcatttgaatgatcatttcgagcggcgcacggaagcggcgggaagtcatgcgcagaacgtgcctttcactgagcaaaatactaggagcaacccttcttcgcagccgtgctctgcagctggagtataccctgcacagaatgtattttcagaggctgccagtggagaccgcacctcaccagaagcgtatcgtgctaagcacgagatcactattgtcggaaatgaggctccagctccattcatgacatttcagtccacaggtttccctccagagattctaagggaggtaagtgcacacaatttacatgactatttaatgcattttcttgtatccttctcgaaagaaattaggaggtcattgtgcgttcatactacgtatgtgataactacgctggatgttcatctcagcaggctcttcaagtcaacaatctatgtcaaggtacagcaagcgggattctctgcaccaactcctatccaagctcaatcatggccaattgctcttaggaatcgtgatattgtagctgtggcgaagacaggttccggaaaaacactgggttatctcattccagggtttatccttcttaagcgccttcaacataattcaagggatggtccaacggtattagtgctttctccaacaagggaattggcaacacaaatccaagatgaagcgaaaaagtttgggagatcgtcaagaatatcgtctgtttgtttatatggaggtgctcctaaaggtcctcagctaagagatctagagcgtggtgcagacattgtggttgcaactcctggaagattgaatgacattttagaaatgcgaagagtgagcctacatcaagtatcttatcttgttcttgatgaggctgaccgcatgcttgatatgggttttgagccacaaataagaaaaattgtgaaacaagtacaacccaaacgacagactcttatgttcactgccacttggccaaaagaggtgaggaaaatagcctcagatttgctgtccaatccagtccaagttaacattgggaacactgatcaactggttgccaataagtcaatcactcagtatgtggatgttatcacacctccggagaaatcgaggcggcttgatcaaatcctaaggtcacaggaacctggatcgaaaatcataatattttgctccacaaagaggatgtgtgatcagctggctcgaaacctagcacggcagtatggtgcttctgctattcatggtgataaatcacaagccgagagggattctgtgttgagtgaatttcgaagtggcagatgccctattcttgttgctactgatgtggctgcccgaggcttggacataaaggatatcagagttgtggtcaactacgatttcccaacaggtgttgaggattacgtccatagaattgggagaacaggacgggctggagcgactggagttgcctatacattcttctgtgatcaggattcaaagtatgcttcagatctcgtgaagattttggagggtgcaaaccagtctgtttcgcaacagttgagagatatggtctcccgtggagggtatggtggaaggtcacggcgctgggcatcttcagatgactcttatggtggtcgaggatatgattcaggctatacttcaaggtcgactgacaactataacagtggttatggcagtcagtctgggaatggttctagctttcatagtagcttccataacagcaacagtggcaatcagtttggcgatacttctggcttccaaaccagctttcataacagcagcagcaacaatcaaaccagtgacaatccaagctttcatgccagcagcaacaacgatcaacctggtgatggtctcagctttcatgccaggttctatagctcttctcgaggcagcgatcagagcagaacaaacaatgctggctttcgtgatagaagtaggagtcctccaagcaatcgcaaccatgaagatcctgggtccaaggctgttggtgtctccaactggtaa

SEQ ID NO: 81 - protein, 759 aa, Oryza sativa
MASAAAAAATARGPRYAPPDPTLPKPWRGLIDGNTGYLYFWNPETKAVQYDRPTAPPPSSPPAQQPPERPRNSDPAESQAQAGASRTQNAAPADDRARNDHLNDHFERRTEAAGSHAQNVPFTEQNTRSNPSSQPCSAAGVYPAQNVFSEAASGDRTSPEAYRAKHEITIVGNEAPAPFMTFQSTGFPPEILREVSAHNLHDYLMHFLVSFSKEIRRSLCVHTTYVITTLDVHLSRLFKSTIYVKVQQAGFSAPTPIQAQSWPIALRNRDIVAVAKTGSGKTLGYLIPGFILLKRLQHNSRDGPTVLVLSPTRELATQIQDEAKKFGRSSRISSVCLYGGAPKGPQLRDLERGADIVVATPGRLNDILEMRRVSLHQVSYLVLDEADRMLDMGFEPQIRKIVKQVQPKRQTLMFTATWPKEVRKIASDLLSNPVQVNIGNTDQLVANKSITQYVDVITPPEKSRRLDQILRSQEPGSKIIIFCSTKRMCDQLARNLARQYGASAIHGDKSQAERDSVLSEFRSGRCPILVATDVAARGLDIKDIRVVVNYDFPTGVEDYVHRIGRTGRAGATGVAYTFFCDQDSKYASDLVKILEGANQSVSQQLRDMVSRGGYGGRSRRWASSDDSYGGRGYDSGYTSRSTDNYNSGYGSQSGNGSSFHSSFHNSNSGNQFGDTSGFQTSFHNSSSNNQTSDNPSFHASSNNDQPGDGLSFHARFYSSSRGSDQSRTNNAGFRDRSRSPPSNRNHEDPGSKAVGVSNW

SEQ ID NO: 82 - DNA, 2379 bp, Oryza sativa
atgtcggcagggaccgccccggccgcgccgcggtacgcgccggacgacccgtcgctccccaagccgtggcgcgggctcgtcgacggcaccaccggctacctctactactggaacccggagaccaacatcacccagtacgagaagccgctgccgcccgaggaccagctcccgccgcccccgccgctccccccgccgcctccccgctccggccgaggcgaccgagaccgcgaccgccgcgaccgctcccgatcccgcaccccgccgcggcgcgaccaccgggaccgcgaccgggaccgcgacaggcgccacgacgaccacaggtcggcgccttcccaccaccatcctcttccggccgccgccgccatcgccgccgatgatccctccaccgaggcgtatcgccaccgccacgagatcaccgttgtcggggacaacgtgccagctccgataacttcgtttgagactggtggattcccaccggaaatcctcaaggagatacaacgtgctggattctcaagtccaacgccaatccaagctcagtcatggccaattgccttgcagtgtcaagatgttgtagctattgcaaagacaggatctggaaaaactcttgggtatctacttcctggatttatgcatattaaacgcttgcaaaacaacccaaggtctggtccaacagtgctagttttggcaccgacaagggagcttgcaactcagattttggaagaagctgtgaaatttggcagatcatcaagaatttcttccacgtgtctatatggtggtgctccaaaaggcccccagctaagagatttggatagaggggtcgatgtcgttgttgctacaccaggaaggttgaatgacatcctagaaatgcgaaggataagccttaagcaagtgtcgtaccttgttctagatgaagctgaccgtatgttggacatgggatttgaaccacaaattcggaagatagtgaaagaaattcctcctcgtcggcaaaccctcatgtacactgctacttggcctaaggaagtccgacgaattgcagaggatcttcttgttcaccctgtccaggtgaccattggaagtgttgatgagcttgttgctaatagtgctattactcagaatgtggagctgatcacaccgtccgaaaagcttcgccgtctggagcaaattttgcgatcccaggattcaggttcgaaggtactaatattctgtaccactaagagaatgtgcgaccaacttgcaaggacacttactaggcaatttggagcttctgccattcatggtgataagtcccaaagtgaaagagagaaggtcctgagccattttagatctgggcgatctcctattttggttgcaacagatgttgctgcacgaggcttagacatcaaagatatcagggttgtgatcaattatgatttccccactggcattgaagattatgttcaccggattggcaggactggaagggctggtgccactggtgtggcctatacgtttttctgtgaccaggattcaaaatatgctgctgatcttattaaaattctggaaggcgcaaaccaacgtgtgcctcgtgacttggcggacatggcctctcggggtgggcgtggtggtaggaagcgtaaccggtgggcaacccgctctgataggggtggttcgcattctgaactggattctaggtatggtggaagagatggtctgtcagggtcttctggcagattggatagtagtcgcagtagtcgcaggcatgactatggtgatgatggacggtctcgcaggtctgggagaggtcgcagtaggagccgtagcagaagtgacagtgataggtatagccgaagtcctaagaggtcacgccgtcatagccgtagcaggaccaggagtcggagccgaagcaggagcaggagctacactaggaaccgtcgtgctagccgcagcaggagccgtagccctggtgctagccgtaggcatgaaagaagcgctactggctctgggtctgcactgccagactctgggcacggtgagcgcaaaagaacaccagaagctgacccatcaagaaaccatacaaaccactcagacccgaaagatgaccgacacccagaggatgggaaggtgggaaaggttgatctcgatcggtcgcctactccacaagacaagtctggcccatatagtcctgcttacaatggaaaaaccagtcgctcagtgagccctggtaatcaggtggaaggaaacaacaaagctgcggaggtttctaagaatcctgatccttcatcgccaccccatcatggtaagaccagggaggacgaagaggaaggtatgatagatgaagatggagagatagctgatgatcctcgggcaaatgcaaccgtgcagaatggcggtgataattga

SEQ ID NO: 83 - protein, 792 aa, Oryza sativa
MSAGTAPAAPRYAPDDPSLPKPWRGLVDGTTGYLYYWNPETNITQYEKPLPPEDQLPPPPPLPPPPPRSGRGDRDRDRRDRSRSRTPPRRDHRDRDRDRDRRHDDHRSAPSHHHPLPAAAAIAADDPSTEAYRHRHEITVVGDNVPAPITSFETGGFPPEILKEIQRAGFSSPTPIQAQSWPIALQCQDVVAIAKTGSGKTLGYLLPGFMHIKRLQNNPRSGPTVLVLAPTRELATQILEEAVKFGRSSRISSTCLYGGAPKGPQLRDLDRGVDVVVATPGRLNDILEMRRISLKQVSYLVLDEADRMLDMGFEPQIRKIVKEIPPRRQTLMYTATWPKEVRRIAEDLLVHPVQVTIGSVDELVANSAITQNVELITPSEKLRRLEQILRSQDSGSKVLIFCTTKRMCDQLARTLTRQFGASAIHGDKSQSEREKVLSHFRSGRSPILVATDVAARGLDIKDIRVVINYDFPTGIEDYVHRIGRTGRAGATGVAYTFFCDQDSKYAADLIKILEGANQRVPRDLADMASRGGRGGRKRNRWATRSDRGGSHSELDSRYGGRDGLSGSSGRLDSSRSSRRHDYGDDGRSRRSGRGRSRSRSRSDSDRYSRSPKRSRRHSRSRTRSRSRSRSRSYTRNRRASRSRSRSPGASRRHERSATGSGSALPDSGHGERKRTPEADPSRNHTNHSDPKDDRHPEDGKVGKVDLDRSPTPQDKSGPYSPAYNGKTSRSVSPGNQVEGNNKAAEVSKNPDPSSPPHHGKTREDEEEGMIDEDGEIADDPRANATVQNGGDN

SEQ ID NO: 84 - DNA, 4197 bp, Oryza sativa
atggcagctacagaggccgccacagattcatcgggtccgcgatatgctcctgatgacccaacgctccctgcaccctggaaaggactaatcgatggatcaaccttgtactactggaaccctgatactaatgagactcaatatgagaggccggtggccgctgtgcctcccttgccaacaggtcctcctccagtaaccactacacctatgccaacatccgcatcaggggctttttcacagcctagcatgcagtcgaaccaaggtggtcaagtatcacagtcccagcaggaacgacctggtcagacagtataccctcaagccagccatcttgggcatcagcaactccaacagccaacccagcaatcaccgtttcagccaacggctcagcatcaagctccgtttcagcattcacaacgagcgccctatcaacaacagcagcagcagatgtcgcagcaacctcctgcccatcagtaccccagcacacatccacaacatatgccataccagcatggccattatatgcaaccccagcagcagcagtttcagcagggcccacaatattcatatcaggttggccagcagcaacagatgccgcaagctgcctacaatcaaggtcagcagcagcctatttctcaagctgcctacaaccaaagtcagcagccagcgcaagccgtgggtgcctacaatcaaggtcagcagccgcctgtttctcaagcctcatacaaccaaagtcagcagccaacacaagctgcaggtgcctacaatcaaggccagcagccgtcaatgccccaagcttcctataatcaagttcagccgccacaaatggcacatgctacttacaatcaaggtcagcagccacctggaatgaggatccctcagggtcaggtgcaacctcagcaatcaccgggctttcatcaacccgctcaggtttcacaagtgctgcaaggttcacagtctcaaggacttcaaatgccgccacagcaaggccaactccagcatggcttccatttgacaactcctcagggaaaacaaccacatcatggccatgtaggtcctcaattgagccaagtgccacttgggcagcagagttccactctgaaggttgacgagacaggagttacaggaggtcttgatggaaaacagactggtttttcattaccactcagtcagcagcgtggccagggtcctgtttcaaaacaacagttaccttctaatcatcaactttctggatcacataatcagccaaatattcctggagctggagggccatcatatcctgcaaagcatcatcttggtggatcatccccaggcgaggctaacaacatgaattttttgagctcacctgctcaaatgcatcaaggtggtatggatacaaactatcgacaacatccagctagcagtcctgtcgttccaaatcatattggtccttcaccagttcggcctccaatgggtttcaagatgggcagtagtgaggatcactttgaaagaaatgagctttactcttctggcaggatggatggaacaaataatctccagcagcagccaaagcttgctgcactaccaccactaaaccggccgcaggatatgaggaacgggccgccttatcctcagccagataatttaggggcttttaacatgggacctccacattcagtgccaaatttgcataaccatggtccgtttcctgaagcttcaatgaggcctccgtccagaatgtttgctcccccaaattttccgagcattgcttcagctgacgcatatcgtcaacaccatgaagtcactgcagtgggtgagaatgtgcctcctccatttatgacattcgaggctactggattccctccagagatcttgcaagagatccatgcagctggcttcttaaaccccactccaattcaagctcaaacatggcctgttgcactgcaaaatcgggacatagtagctattgccaagacaggatcagggaagacgctggggtaccttattcctgcttttatacatcttaggcgataccaaaacaacccaatgttgggccctacagtgttagttttggcccctacccgagagcttgcttcacaaatacaagacgaagcagtcaagtttggtcgatcatctagagtctcctgcacttgtctgtatggggggacttcaaagggccttcagctaagagaacttgagcgtggagcagatattgtcgttgcaactcctggacgtcttaatgatatcctggagatgaggaagattagtctccatcaagtttcatttcttgtgcttgatgaggctgaccgtatgcttgatatgggttttgagccacaaatacgtaagattgtggatgagattcctcgaaacagacagactctgatgtatacggccacttggccaaaggaagttacaaaaattgctggggatttactgaaagatcctgttcaggttaatattggtagcattgatgaactcgttgccaacaaatccatcacacagtatgtagaggtggttccaccattggacaagcagcggcgattggagcagatacttagagctcaagaaaggggctctaaggtcatcatattctgctcaaccaagaaaatgtgtgaccagcttgctcgtgacattggtcgtagttttggtgctgcaagtattcatggtgataaatcacaggctgaaagggataatgttctgaatcagtttcgcactggcagagctccaatattagtagccacagatgttgctgctcgtgggcttgacatcaaagatatcagagtagtgatcaattatgactttcccactgggatcgaggactatgttcaccgtatagggcgtacaggaagggctggggcaactggagtctcatatactttcttttctgaacaagattggaaatatgctggtgatttggtgaaagtcttggaaggtgctaatcagcatgtccctccagagttgcaagagatggctgcaagaggtgcagctggagctccaagaaatcaagctggtgggatgagccgttgggatggacctggtggtggtggtaaccgttttgaatctgctgttggtattcctggtagttatggtggaattagggatggcccaggcggctttggtggccgtgatggcccaggcggttttggtggacgggatggcccaggcggctttggtggtcgggatggccctgggggttttattggtcgagaaggtcctggtggctttggcggtcgggagggtcctgttggctttggtggtcaggagagtcctggtggctttggtggacgcaagggacctggtgcctttgaaggtcgagagggtgctgctcctggtagctttggtgggagaggtggtcgtggacctggtggttttggtggcagaggtggaggaagtcctggtggttttggtggccgtggtggcaggggtgattctcatggttttggtggacgtgggaggggtgacttttctggctttggtggacgtggcaggggtgattcttctggctttggtggacgaggccgtggtgatttctctggtggacgtggtgggagagggcgtggatttggagggcgtggacgatctgaccgaggcccacatgaccgttttatctcagatggacgtggaagatacgataaccgccgaggatttggtggcaagggtcgggaccggagctacagccgcagcccagatagaggccgctcgcgaggctatgaccgaagaagtggcagtaggagcctaagtagtaggagcagaagccgaagcaggagctggtcacgtagtaggagccgcagcaggagctggagccggagccgtagccgcagccgcagcccaagtcgcagcaggagcagaagctatgaccagggtgcaggaccggcacgcaggccccggcctagatccggcttcgatgtcctgccacctgcaaccggagccggtcctgcttcaaccggtcctgggcctgtagctgtacctgcacctggatcagcaggtcctgttcccccgcaggtacctgcacaatcactggctgatgcatctgcaatgtcaccaatgtcaccaggtggcctagcacaagaaggtgcaccgttcaacggcgggaacgatggcggcctcgtcccagcacaaggggtactccctttccagggttctgatgtagcaatgccaccaaattttgctgcagctgaagcgtttccaggcccggcagttgagcaggaagcccctgatgtataa

SEQ ID NO: 85 - protein, 1398 aa, Oryza sativa
MAATEAATDSSGPRYAPDDPTLPAPWKGLIDGSTLYYWNPDTNETQYERPVAAVPPLPTGPPPVTTTPMPTSASGAFSQPSMQSNQGGQVSQSQQERPGQTVYPQASHLGHQQLQQPTQQSPFQPTAQHQAPFQHSQRAPYQQQQQQMSQQPPAHQYPSTHPQHMPYQHGHYMQPQQQQFQQGPQYSYQVGQQQQMPQAAYNQGQQQPISQAAYNQSQQPAQAVGAYNQGQQPPVSQASYNQSQQPTQAAGAYNQGQQPSMPQASYNQVQPPQMAHATYNQGQQPPGMRIPQGQVQPQQSPGFHQPAQVSQVLQGSQSQGLQMPPQQGQLQHGFHLTTPQGKQPHHGHVGPQLSQVPLGQQSSTLKVDETGVTGGLDGKQTGFSLPLSQQRGQGPVSKQQLPSNHQLSGSHNQPNIPGAGGPSYPAKHHLGGSSPGEANNMNFLSSPAQMHQGGMDTNYRQHPASSPVVPNHIGPSPVRPPMGFKMGSSEDHFERNELYSSGRMDGTNNLQQQPKLAALPPLNRPQDMRNGPPYPQPDNLGAFNMGPPHSVPNLHNHGPFPEASMRPPSRMFAPPNFPSIASADAYRQHHEVTAVGENVPPPFMTFEATGFPPEILQEIHAAGFLNPTPIQAQTWPVALQNRDIVAIAKTGSGKTLGYLIPAFIHLRRYQNNPMLGPTVLVLAPTRELASQIQDEAVKFGRSSRVSCTCLYGGTSKGLQLRELERGADIVVATPGRLNDILEMRKISLHQVSFLVLDEADRMLDMGFEPQIRKIVDEIPRNRQTLMYTATWPKEVTKIAGDLLKDPVQVNIGSIDELVANKSITQYVEVVPPLDKQRRLEQILRAQERGSKVIIFCSTKKMCDQLARDIGRSFGAASIHGDKSQAERDNVLNQFRTGRAPILVATDVAARGLDIKDIRVVINYDFPTGIEDYVHRIGRTGRAGATGVSYTFFSEQDWKYAGDLVKVLEGANQHVPPELQEMAARGAAGAPRNQAGGMSRWDGPGGGGNRFESAVGIPGSYGGIRDGPGGFGGRDGPGGFGGRDGPGGFGGRDGPGGFIGREGPGGFGGREGPVGFGGQESPGGFGGRKGPGAFEGREGAAPGSFGGRGGRGPGGFGGRGGGSPGGFGGRGGRGDSHGFGGRGRGDFSGFGGRGRGDSSGFGGRGRGDFSGGRGGRGRGFGGRGRSDRGPHDRFISDGRGRYDNRRGFGGKGRDRSYSRSPDRGRSRGYDRRSGSRSLSSRSRSRSRSWSRSRSRSRSWSRSRSRSRSPSRSRSRSYDQGAGPARRPRPRSGFDVLPPATGAGPASTGPGPVAVPAPGSAGPVPPQVPAQSLADASAMSPMSPGGLAQEGAPFNGGNDGGLVPAQGVLPFQGSDVAMPPNFAAAEAFPGPAVEQEAPDV

SEQ ID NO: 86 - DNA, 2028 bp, Physcomitrella patens
atggtcggcgctgctgtttcggcggctcctcgatatgctcctgctgatccgacactaccgcccccatggacagcgttggtggatggaaacacggggtatatctactactggaaccctgacacaaatattacacagtatgataggcctttgcctttggtaggatccgggcgccctttaccctctggtcctcctccttcgtcggttatatctggaacaaagttggctgcaattcctagcgggaaagatcaacctaacggggtgtcgggatctgctcctcctgtgggaatgggattatctggaggtcagaaacatggtgcgggcgtttatgatgatgccgatcgtgatggttattacaagcgtccaagagtagaggcctatgcaaatgtccccacttcagatatcgattcttacagaaagcttcacgaagtgtctgccttgggagaaaatgtccctgctccttttctgtcatttgaagcagttggacttccaccggacatgctcagagagatacaagcggctggttttaaatcccccacgccaattcaagctcaatcttggccaatagccatgcaaaaccgggatattgttgcaattgcgaagaccggatctggtaaaactttgggttatttgataccagcctttcttcatctcgaacgtcatcggaataattcaagacttggaccaagtgttctcgtgatagctcctactcgtgaattagctacacagattcaagaggaatgcgtgaagtttggaagatcctcaaggattacaagcacgtgtgtttatggaggcgcccccaaaggtcctcagttgcgagacatcgagcggggagctgatatcgtaatagctactccagggcgtttgaatgactttttggaagtaaagaaaatcagtcttcggcaagtgtcttatctcgtattagacgaagcagatcgtatgcttgatatggggtttgagcctcaaattcgaaaaattgtgaacgagattctgtcacgacggcagactctcatgtatactgctacgtggccgaaagaagtacgcaagattgcaggggatttacttatcaaccctgtccaggtcaacattgggaacacagatgagctttctgcgaacaaatctattactcagcatgtggaagtggttgtgccctatgagaagcagcgtcgactagaacaaatattacgttcacaagagcctggctctaagattatcgtattttgttctaccaagcgcatgtgtgacatgctctcacgcaatttaggccgtgactttggcgcagccgcaatccacggagacaaatcgcaaagtgaacgggattttgttctgtcccaatttaggacgggaagaactcctatccttgttgcgactgacgtggctgcccgagggcttgacattaaagacatcaggtttgtcgtgaattatgatttccctacgggagttgaagactacgttcaccggattggacggacaggtcgagctggtgcaaccgggcttgcatatacattcttttctgaacaggatgggaaatatgcgaaggaacttattaaagtacttgaaggagctaaccagaaggtgcctcaagaactgaaggacatagcgagtaggggtggagggatgttcaaaagtcgcacgggcaatcgttggggtggtgactctggtaaagggggaagggatggtggacgaagcagctatggaggagggcgtggcgattttggtggaagaggtggtttttatggtggtggccgggatgggggcaggtttgatagccgggatcgctatggtgaccgtctgccagaccgtagtcatgaccgatacgtcgcaccgggcggggctagatatggggagaaggacaaaagcaagaatcgcagccgcagctacagccgaagtcctagtcggtccagggcatacagtcgcagcagaagccgcagctatgagcgctacagtgacagcagaggaagagatcgtagcagatccccagctagtcgtagatcgtattccccggacggagggcggggtggacgacgatag

SEQ ID NO: 87 - protein, 675 aa, Physcomitrella patens
MVGAAVSAAPRYAPADPTLPPPWTALVDGNTGYIYYWNPDTNITQYDRPLPLVGSGRPLPSGPPPSSVISGTKLAAIPSGKDQPNGVSGSAPPVGMGLSGGQKHGAGVYDDADRDGYYKRPRVEAYANVPTSDIDSYRKLHEVSALGENVPAPFLSFEAVGLPPDMLREIQAAGFKSPTPIQAQSWPIAMQNRDIVAIAKTGSGKTLGYLIPAFLHLERHRNNSRLGPSVLVIAPTRELATQIQEECVKFGRSSRITSTCVYGGAPKGPQLRDIERGADIVIATPGRLNDFLEVKKISLRQVSYLVLDEADRMLDMGFEPQIRKIVNEILSRRQTLMYTATWPKEVRKIAGDLLINPVQVNIGNTDELSANKSITQHVEVVVPYEKQRRLEQILRSQEPGSKIIVFCSTKRMCDMLSRNLGRDFGAAAIHGDKSQSERDFVLSQFRTGRTPILVATDVAARGLDIKDIRFVVNYDFPTGVEDYVHRIGRTGRAGATGLAYTFFSEQDGKYAKELIKVLEGANQKVPQELKDIASRGGGMFKSRTGNRWGGDSGKGGRDGGRSSYGGGRGDFGGRGGFYGGGRDGGRFDSRDRYGDRLPDRSHDRYVAPGGARYGEKDKSKNRSRSYSRSPSRSRAYSRSRSRSYERYSDSRGRDRSRSPASRRSYSPDGGRGGRR

SEQ ID NO: 88 - DNA, 1839 bp, Solanum lycopersicum
atggctgctattttaactgcatcatctggtccaagctatgcaccagaagaccccactctccccaaaccttggaaaggcctagttgatggtacaacaggatatatctacttctggaatccagagaccaatgatacccaatatgagaggcctgttcactcatccaatggagtgtctgctctagcacaaaagtcagctgtatttgttagttcatctgtccaaaaaccctctcaaggtcaacattatgatccagacggtaggcatagcagaggtagcaacaacaaggttacatccctgaagggagatcagaatgcgagaagcagttctgatcatcacgaaggctatgattctctaggtgtaggaactgacatatctcaggaatcctattgccgccacaatgagatctctgttacgggaggtgatgttcctgcacctttgacatcatttgaagcgactgggtttccttcagagattgtgagggagatgcgtcaagctgggttttcagctcctactccaattcaggcacaatcgtggcctgttgcccttcagggccgtgacatagtagctattgccaagactgggtctgggaaaactttgggttacttaattccaggctttattcatctaaaaaatcgccgcagtaatcctcaattaggcccaactattttggttctctcaccaacaagagagttagcgacacagatacaagctgaagctgtgaagtttgggaaatcctctaggatatcttgcacgtgcttgtatggaggtgctccaaaaggtcctcaacttcgagagttgagtaggggtgtagatattgttgtcgccactcctggtcgtttgaacgacatattggaaatgagaaggcttagtcttggtcaagtttcttacctggtgttagatgaagcagatcgtatgctggacatgggatttgaacctcagataagaaagattgtgaaagaggtgcctaagcagaggcagacattgatgtatacagctacatggccaaagggggttcgtaagattgcagctgatctattggttaattcagttcaggttaatattggtaatgttgacgagcttgctgcaaacaagtctataacacagcacattgaagtcttgtcttcgatggagaaacaacggcgactagaacaaattttgagatccaatgaaccagggtcaaagatcattatcttctgttcaacaaagaaaatgtgtgaccaactatctcgcaatcttactcgcaactttggagcagctgcaattcatggggataaatctcagggtgagagggattatgtattaagtcagttccgcactggcaggtctcccgtgcttgtggctactgatgttgctgcgcggggtttagacatcaaagatatcagggtggtggtgaactttgacttcccaactggaatagaggattatgtccacagaattggtaggacaggtcgggcaggggcatctggtctggcctatacatttttctccgatcaggatgctaagcatgctttagatcttgttaaagttttagaaggtgcaaatcaatctgtcccaactgaactgcgtgatatggtttcgcgaggtggtggtatgggaaaggcaaggtggggttctggtcaaggtggacgtggtgggcgcttcaatggaagctatgttagccggaatggaggaaggggagactggaataattcgtcatcagaaagaggcggaggacgtggttatgaccggggatcacgcgatagtgacagatttctacgtggggatgcttcaaggaagcgtagtcgcagcagaagccccaacaagggttcaggatggagtgataaaaagagccggtttgcctga

SEQ ID NO: 89 - protein, 612 aa, Solanum lycopersicum
MAAILTASSGPSYAPEDPTLPKPWKGLVDGTTGYIYFWNPETNDTQYERPVHSSNGVSALAQKSAVFVSSSVQKPSQGQHYDPDGRHSRGSNNKVTSLKGDQNARSSSDHHEGYDSLGVGTDISQESYCRHNEISVTGGDVPAPLTSFEATGFPSEIVREMRQAGFSAPTPIQAQSWPVALQGRDIVAIAKTGSGKTLGYLIPGFIHLKNRRSNPQLGPTILVLSPTRELATQIQAEAVKFGKSSRISCTCLYGGAPKGPQLRELSRGVDIVVATPGRLNDILEMRRLSLGQVSYLVLDEADRMLDMGFEPQIRKIVKEVPKQRQTLMYTATWPKGVRKIAADLLVNSVQVNIGNVDELAANKSITQHIEVLSSMEKQRRLEQILRSNEPGSKIIIFCSTKKMCDQLSRNLTRNFGAAAIHGDKSQGERDYVLSQFRTGRSPVLVATDVAARGLDIKDIRVVVNFDFPTGIEDYVHRIGRTGRAGASGLAYTFFSDQDAKHALDLVKVLEGANQSVPTELRDMVSRGGGMGKARWGSGQGGRGGRFNGSYVSRNGGRGDWNNSSSERGGGRGYDRGSRDSDRFLRGDASRKRSRSRSPNKGSGWSDKKSRFA

SEQ ID NO: 90 - DNA, 2307 bp, Glycine max
atgtcgaagaggaagttcggattcgaagggttcggcataaaccgccaatccacctacagcttcgagcgatcccagccccctcagcgactctacgtccctccctccgcgcgccacggccacgaccactacgaagacaccgacatcgacaacatcgacttcgacgacaacaacaacgacgacgggagcaagaataacaacggtggcggcaacgacgacgacgacgaaatcgaccccttggatgccttcatggaggggattcacgaggagatgcgggctgccccgccgccgaaggagaaggcggaggaccggtaccgcgacgacgaggacgacgatcccctggagagctttctgaaggcgaagaaggatttagggttgactctcgcgtccgacgcgctgcacgctgggtatgattccgacgaggaggtttatgctgctgccaaagctgtggatgctggtatgattgagtatgattctgatgataaccctattgttattgacaagaagaaaattgaacccattcctgctctcgatcactcttccattgattacgagcctttcaataaggatttttatgaggagacaccttcaatatcaggtatgagtgagcaggatgtaagtgaatacagaaagagtttggctattcgtgtatcgggttttgatgttcccaagccaataaagacatttgaggactgtgggtttccttcgcagattatgaatgctattaaaaaacaaggatatgagaagccaacatctatacaatgtcaggctttgccagttgtgctttcgggcagggatatcattggtatagcaaaaactggttctggtaaaactgcttcttttgtgcttcctatgattgtgcatatcatggatcagcctgagcttcagaaggaggaggggcctataggggtcatatgtgcacctaccagagaattggcgcatcaaatatatctggaggccaagaaatttgcaaaagcatatggggtgcgtgtctctgctgtctatggtggaatgtcaaaacttgaacagttcaaagaactgaaggcgggatgtgagatagttgttgctacaccaggaagattaatagacatgctgaaaatgaaggcattgacgatgatgagagcaacttacctggtgcttgatgaggctgatcggatgtttgatcttgggtttgagccgcaagtaaggtcaattgttgggcagattaggccggaccgccaaactttactcttttctgcaactatgcctcgaaaagttgaaaagttggccagggaaatcctttctgatcctattagagtaactgttggagaggtggggatggcaaatgaagatattactcaagttgttcatgtaattccttccgattctgagaaattgccctggcttctggaaaagctgcctgaaatgattgatcaaggtgataccctagtttttgcttcaaaaaaggctactgtggatgaaattgaatcacaattggctcaaagaggctttaaagttgctgccttgcatggtgataaagatcaagcttctcgtatggatattttacagaagtttaaatctggcctctaccatgtgctaattgcaactgatgttgctgcccgtggtcttgacatcaagtcaattaagtcagtggtaaactttgatattgcaaaagatatggacatgcatgtccatcgcattggaagaacaggccgtgctggtgacaaggatggggttgcatacactcttataactctgaaagaagcacggtttgctggtgaattggtcaatagcttagttgctgctggtcagaatgtgtctgtggagttgatggatcttgctatgaaggacgggagattcaggtcaaaacgtgatgcaagaaaaggaggtggaaaaaaaggcaaaggtagaggtgggggtggcagaggcgtgcgaggagtggattttggcttgggtattggatataattctgagtcaaataacgcaccatctaccacagctcccagtcgatctgctgccgtaaattctctgagaacaggaatgatgtcacaatttaagagtaactttgttgctgcttcatcaaactctcagaatcaaggattcggtagcaatacaagcatggctgctaataagagaccagcactccctggttttgtatccggtggatcaattggcggtgacataaatacttatcagaatactgcttcacccaatcctgctacatcagcggtaaattccaccagtcaagtttctggagtaaatcctggtcagaagaacacgaacagttctaaacctaaagaaaggcggaggccatcaggttgggatagatag

SEQ ID NO: 91 - protein, 768 aa, Glycine max
MSKRKFGFEGFGINRQSTYSFERSQPPQRLYVPPSARHGHDHYEDTDIDNIDFDDNNNDDGSKNNNGGGNDDDDEIDPLDAFMEGIHEEMRAAPPPKEKAEDRYRDDEDDDPLESFLKAKKDLGLTLASDALHAGYDSDEEVYAAAKAVDAGMIEYDSDDNPIVIDKKKIEPIPALDHSSIDYEPFNKDFYEETPSISGMSEQDVSEYRKSLAIRVSGFDVPKPIKTFEDCGFPSQIMNAIKKQGYEKPTSIQCQALPVVLSGRDIIGIAKTGSGKTASFVLPMIVHIMDQPELQKEEGPIGVICAPTRELAHQIYLEAKKFAKAYGVRVSAVYGGMSKLEQFKELKAGCEIVVATPGRLIDMLKMKALTMMRATYLVLDEADRMFDLGFEPQVRSIVGQIRPDRQTLLFSATMPRKVEKLAREILSDPIRVTVGEVGMANEDITQVVHVIPSDSEKLPWLLEKLPEMIDQGDTLVFASKKATVDEIESQLAQRGFKVAALHGDKDQASRMDILQKFKSGLYHVLIATDVAARGLDIKSIKSVVNFDIAKDMDMHVHRIGRTGRAGDKDGVAYTLITLKEARFAGELVNSLVAAGQNVSVELMDLAMKDGRFRSKRDARKGGGKKGKGRGGGGRGVRGVDFGLGIGYNSESNNAPSTTAPSRSAAVNSLRTGMMSQFKSNFVAASSNSQNQGFGSNTSMAANKRPALPGFVSGGSIGGDINTYQNTASPNPATSAVNSTSQVSGVNPGQKNTNSSKPKERRRPSGWDR

SEQ ID NO: 92 - DNA, 3501 bp, Arabidopsis thaliana
atggaggtagagaaatccaagtataggagcgaagatttggatgtggtggaggaggaggctgatttgaagaagagtcggcgagatcgtgatcggagtaatgagcggaagaaggataagggttcagagaagcgtcgagagaaggataggcggaagaaacgagttaagagtagtgattctgaagatgattacgatagagatgatgatgaagagagggagaagcgtaaggagaaggagagggagcggagacggagggataaggatagggtgaagagacggtctgagagaaggaagagtagtgattctgaagatgacgttgaagaagaggatgagagggataaacgcagagtgaatgagaaggagagagggcatcgagaacatgagagagatagaggcaaagataggaaaagggatagagagagggaagagaggaaggataaagaaagagaaagggagaaggatagagagaggagagaacgggaacgggaagagcgggagaaggagagagttaaagaaagagaaaggcgggaacgggaagatggagagagggataggagagagcgtgagaaagaaaggggtagtaggaggaaccgggaaagggaaaggtcaagagaggtgggcaatgaagagagtgatgatgatgtcaagcgtgacttgaaacgtagaagaaaagagggcggtgaacggaaggagaaagagcgtgaaaagagtgttggcagatctagcaggcatgaagatagtccaaagagaaagagtgtcgaggataatggggaaaagaaagagaagaaaacgcgagaagaagaactagaggatgagcagaagaagttggatgaggaagtggaaaaacgaaggagaagagtccaggagtggcaagaattgaagaggaagaaggaggaagctgaaagtgaaagtaagggtgatgcggatggtaatgagcccaaggccggtaaggcttggactcttgaaggagaatctgatgatgaagaaggccatccggaagaaaaatcagaaacagaaatggatgttgatgaagagactaaacctgaaaatgatggagatgctaagatggtagacttggagaatgagacagctgctactgtctctgagagtggaggtgatggagctgtagatgaagaggaaattgatcctttagatgcttttatgaatactatggtattacctgaggttgagaagttttgcaatggtgctcctcccccagcagtgaacgatggtactttggattctaaaatgaatgggaaggaaagtggtgaccggccaaagaaaggttttaataaggcccttggtaggataattcaaggtgaagattctgattctgattattcagaaccaaagaatgatgatgatccaagtttagacgaagacgatgaggagttcatgaagagagtaaagaagacaaaagctgagaagttgtcccttgttgaccactcaaaaatagagtatgaacctttccggaagaacttctatatcgaagtgaaggatatctctaggatgacacaagaagaagttaacacttacagaaaggaattggagctgaaagttcatggaaaggatgttccaagacccataaagttttggcaccagactgggctaaccagcaaaattttggatactatgaagaagcttaattatgaaaagccaatgcctattcaaacacaagcactccctatcatcatgagcggtcgagactgcattggggttgcaaaaaccggttcaggtaaaacccttggttttgttttgccaatgctgaggcatattaaagatcagcctcccgttgaagctggtgatgggccaattggtcttgtaatggcacctactagggagcttgttcagcagattcacagcgatatcagaaagttttctaagccattgggtataagatgcgtccctgtgtatggaggatcaggagttgcccagcaaattagtgaacttaagcgaggtactgagattgttgtgtgcactcctgggagaatgattgatatcctttgcacaagcagtgggaaaatcactaatctgcgaagagtcacatttttggtaatggatgaagctgatcgtatgtttgacatgggttttgagcctcaaattactcgtattattcagaacattcgaccggaacgccaaactgtgcttttttctgccacttttccacgccaagttgaaactttggcacgtaaagtcttgaacaagcctgtagaaatacaggtcggtggaaggagtgttgtgaataaggatataactcagttagttgaagtcagaccggagagtgataggttccttagacttctggaacttcttggggaatggtctgagaaagggaaaattctggtctttgttcagtcgcaggaaaaatgtgatgccttgtatagggatatgattaaatctagttacccttgtctgtctcttcacgggggtaaggatcagaccgatcgtgaatcaactatatctgattttaagaacgatgtctgcaatttgttgattgccacaagtgttgctgctaggggtctagatgtgaaagagcttgagttggttgtaaactttgatgcgccgaaccactatgaagattatgtgcatcgcgttggcaggacaggcagggcagggcgtaagggctgtgctgtgacatttatctccgaggatgatgcaaaatatgcaccagatttagtcaaggccctggagctttctgagcagccagttcctgatgatctgaaagcacttgctgatggtttcatggtgaaagtgaaacagggtattgagcaagctcatggaactggctatggtggtagtggctttaaattcaacgaagaggaggaagaagttagaaaagcagcaaagaaagcacaagcaaaggagtatggctttgaggaagacaagtctgactcagaagatgagaatgatgtagtaagaaaggcaggtggtggtgagatctcacagcagcaggctacttttgctcagatagccgccattgctgctgctgccaaagctgctgctgctgctccagtgagtgctcctgtgacagctaaccaattactggcaaatggtggcgggcttgctgccatgccaggtgtccttccggttactgttcctacccttcctagtgaaggggcaggccgtgctgcagccatggttgctgccatgaatctgcaacataatctggcaaagattcaagctgatgcaatgcctgagcactatgaagcagaacttgaaatcaatgacttcccacaaaatgctcgttggaaggtcacccataaagaaactttgggtccaatatcagagtggactggagctgctattaccaccaggggtcagttttatcctacaggacgtataccgggacctggggaacggaagctgtacttattcattgaagggcctagcgaaaaatcagttaagcacgcaaaagctgaactcaagcgtgttcttgaagacattacgaatcaggccatgtcctcacttcctggaggagcatccgggagatactcagtcctttaa

SEQ ID NO: 93 - protein, 1166 aa, Arabidopsis thaliana
MEVEKSKYRSEDLDVVEEEADLKKSRRDRDRSNERKKDKGSEKRREKDRRKKRVKSSDSEDDYDRDDDEEREKRKEKERERRRRDKDRVKRRSERRKSSDSEDDVEEEDERDKRRVNEKERGHREHERDRGKDRKRDREREERKDKEREREKDRERREREREEREKERVKERERREREDGERDRREREKERGSRRNRERERSREVGNEESDDDVKRDLKRRRKEGGERKEKEREKSVGRSSRHEDSPKRKSVEDNGEKKEKKTREEELEDEQKKLDEEVEKRRRRVQEWQELKRKKEEAESESKGDADGNEPKAGKAWTLEGESDDEEGHPEEKSETEMDVDEETKPENDGDAKMVDLENETAATVSESGGDGAVDEEEIDPLDAFMNTMVLPEVEKFCNGAPPPAVNDGTLDSKMNGKESGDRPKKGFNKALGRIIQGEDSDSDYSEPKNDDDPSLDEDDEEFMKRVKKTKAEKLSLVDHSKIEYEPFRKNFYIEVKDISRMTQEEVNTYRKELELKVHGKDVPRPIKFWHQTGLTSKILDTMKKLNYEKPMPIQTQALPIIMSGRDCIGVAKTGSGKTLGFVLPMLRHIKDQPPVEAGDGPIGLVMAPTRELVQQIHSDIRKFSKPLGIRCVPVYGGSGVAQQISELKRGTEIVVCTPGRMIDILCTSSGKITNLRRVTFLVMDEADRMFDMGFEPQITRIIQNIRPERQTVLFSATFPRQVETLARKVLNKPVEIQVGGRSVVNKDITQLVEVRPESDRFLRLLELLGEWSEKGKILVFVQSQEKCDALYRDMIKSSYPCLSLHGGKDQTDRESTISDFKNDVCNLLIATSVAARGLDVKELELVVNFDAPNHYEDYVHRVGRTGRAGRKGCAVTFISEDDAKYAPDLVKALELSEQPVPDDLKALADGFMVKVKQGIEQAHGTGYGGSGFKFNEEEEEVRKAAKKAQAKEYGFEEDKSDSEDENDVVRKAGGGEISQQQATFAQIAAIAAAAKAAAAAPVSAPVTANQLLANGGGLAAMPGVLPVTVPTLPSEGAGRAAAMVAAMNLQHNLAKIQADAMPEHYEAELEINDFPQNARWKVTHKETLGPISEWTGAAITTRGQFYPTGRIPGPGERKLYLFIEGPSEKSVKHAKAELKRVLEDITNQAMSSLPGGASGRYSVL

SEQ ID NO: 94 - DNA, 2283 bp, Arabidopsis thaliana
atgtctaatcgcaaattcggaatggaaggattcggcattaatcggcaaactagctacagtttcgagcgatctcaagcaccgcaacgtctctacgtccctccctcgtctcgcggcggagacaactccgaagatgccgatcttgataacattgattacatggaaaacgaagaagctgaggaagatattgaggaaggcggttctgctgcggctagcggtggcgaggttgatgagatcgatccattagatgcttttatggagggaattcaccaggagatgaaatctgctccacctcctaagccaaaggagaaactagagaggtacaaggacgacgatgacgatcctgttgagagttacctcaaggccaagaaggatttgggcctgacactagccgccgatgcacttaacgccggttataactccgacgaggaggtgtatgctgcagctaaggcggtcgatgcagggatgctagattatgattccgatgataatccgattgttgtggataaaaggaagattgagcctattacagctctggatcatagctccatcgattatgaacctattaataaggacttttacgaggagctagaatcaatatcaggaatgactgagcaagaaaccacggattaccgtcagagattagggattcgggtctcgggttttgatgttcataggccagttaagacctttgaggattgtggattttcctcacagattatgagtgctatcaaaaagcaagcttatgaaaaacctacagcaatccaatgtcaggctttacctattgtgttgtctggtcgagatgttattggcatagccaaaactggttcaggtaagactgcagcgtttgttcttccaatgattgttcatattatggatcagcctgaacttcagagagatgaaggtccaattggtgtcatatgtgctccaaccagagaattggctcatcaaatcttcttggaagccaagaaattttcgaaagcatatggcttacgagtctctgctgtgtatggtggaatgtctaaacatgaacagtttaaggaactcaaggcaggatgcgaaatagttgttgctactcctggaaggttgatagacatgctgaagatgaaggctttgacaatgatgagagccagttatttggttcttgatgaggcagatcggatgtttgaccttggctttgagccacaagtaaggtctattgttggccagattcgtcctgatcgccagactttactattttcagccactatgccttggaaagttgaaaagttagctagggaaatcctttcagatcctattagagtcacagttggtgaagtggggatggccaatgaagatattacgcaggttgtcaatgtcataccttctgatgctgaaaaacttccctggctacttgaaaagctccctggaatgattgatgagggtgacgtattagtgtttgcatctaaaaaggccactgttgatgagattgaagctcaacttactctaaattccttcaaagttgctgctcttcacggtgataaagaccaagcatcacgaatggaaactctgcagaagttcaaatctggagttcaccatgtgctgattgccactgatgttgctgcccgaggtcttgacatcaaatcgcttaagacagtggttaactatgacatcgcaaaagatatggacatgcatgtacatcgtattggtagaacaggccgtgccggtgacagagatggggttgcctacacacttgttacgcagagagaggctagatttgctggtgaattggtaaacagtctggttgctgctggtcaaaatgtgcctccagaactcacagatcttgccatgaaggatggacgattcaagtccaagcgtgacgggagaaaaggaggtaagaaaggccgaggaggaggtggtggaaacaaaggagtacgtggagttgattttggtcttggtattggatttagctcggaatctagtaggacaccttcttctaaagctgcaccaagtagaagtggggcaatcaattcagtgagaactggagtaatggcccaattcaagaatagttttgtcgctgcaacgccatcaaatccacaaaaccaagcttatccaaacaagagaccatccctaatgggctttgtctcaggtggtactattggtggagacatgggtagaactcagagtcaagctcccccagtagcacctactcaaaacgcctcatcacacaactccagccagaatcactcacagagttctgagaatcggcctagagagaggaagagaagatctggttgggataattga

SEQ ID NO: 95 - protein, 760 aa, Arabidopsis thaliana
MSNRKFGMEGFGINRQTSYSFERSQAPQRLYVPPSSRGGDNSEDADLDNIDYMENEEAEEDIEEGGSAAASGGEVDEIDPLDAFMEGIHQEMKSAPPPKPKEKLERYKDDDDDPVESYLKAKKDLGLTLAADALNAGYNSDEEVYAAAKAVDAGMLDYDSDDNPIVVDKRKIEPITALDHSSIDYEPINKDFYEELESISGMTEQETTDYRQRLGIRVSGFDVHRPVKTFEDCGFSSQIMSAIKKQAYEKPTAIQCQALPIVLSGRDVIGIAKTGSGKTAAFVLPMIVHIMDQPELQRDEGPIGVICAPTRELAHQIFLEAKKFSKAYGLRVSAVYGGMSKHEQFKELKAGCEIVVATPGRLIDMLKMKALTMMRASYLVLDEADRMFDLGFEPQVRSIVGQIRPDRQTLLFSATMPWKVEKLAREILSDPIRVTVGEVGMANEDITQVVNVIPSDAEKLPWLLEKLPGMIDEGDVLVFASKKATVDEIEAQLTLNSFKVAALHGDKDQASRMETLQKFKSGVHHVLIATDVAARGLDIKSLKTVVNYDIAKDMDMHVHRIGRTGRAGDRDGVAYTLVTQREARFAGELVNSLVAAGQNVPPELTDLAMKDGRFKSKRDGRKGGKKGRGGGGGNKGVRGVDFGLGIGFSSESSRTPSSKAAPSRSGAINSVRTGVMAQFKNSFVAATPSNPQNQAYPNKRPSLMGFVSGGTIGGDMGRTQSQAPPVAPTQNASSHNSSQNHSQSSENRPRERKRRSGWDN

SEQ ID NO: 96 - DNA, 1563 bp, Chlorella vulgaris
atggcggctgcttctgggtacggttctgacgaggaggtatacgcaacagccagagccgtggatgatgcagaatatggcgactcggacagcggcgctccccttgacaaaaaaaagattgagccgctgcctcccttggatcatgccactgtcgagtatgaagacttcgccaaagttttctacgatgagcatccagccatgacagcaatgacgcatgcggaggtgactgctctacgggccagggtgggcatccgcgtgtctggttttgacgctccaaagccagtgcagacatttgagcagtgcggctttgatggaatgctgatgggtgtgatcaaaaaggcagggtatcaaaagccgactcccattcaggcgcaagcccttccagctgccttggctggcagggacatcctgggtatcgcaaagactgggtcaggcaagacggcagcctttgtcctacccatgcttgtgcacatcatggaccagcctgagctggagaaaggagaagggcccattggcataattgtggcgccaactcgcgagctgtctgagcagatccataaggagacccggcgtttcagcaagccctacaacctgcgcgtctgtgctgccttcggtgggctttccaagtacgaccaattcaaggacttgaaggcgggcgcagaggtggcagtctgtacacctgggcgcatgattgacttgatcaagatgaaggcatgcatgtgcacacgtgtgacctacctcgtgttcgacgaggcagaccgcatgtttgacatgggctttgagccccaggtgcggtcaatcattggccaggtgcggccggaccggcagacactgctgttctcggcaacgctgcccaataagatagatcggctggtacaggatgcgctgacatcgccagtgcgcgtcactgtcggtgagattggggccgccaatgacgacatctcgcaggttgcagaggtgctggatgactctgctaaatggacatggctccaggccaatgtgcaaagcttcattgatcagggtgatgtcctggtatttgtgtccacaaaagttcgggcggaggagatctctggacagcttcaggcagctgggctcaaggcagcggcaatccatggggacatggaccagcacacgcgcatgcaggtgctgcacgatttcaaggctggcaagcaccatgccttggtggccacggatgtggcagcgcgcggcctggacatcaagtccatcaagaccgtggtcaacatagacgcagccaaggacattgacacgcacgtccaccgcgtcgggcgcactggccgcgctggtgacaaagacggcgtcgcctacacgctcgtgactccgcgggaggctcgatttgcaggtgagctggtcaacagcctggcagcagctaatcagcaggtgcccaaagcgctgatggatctagcagccaaggacgggcactttcgcaaggcaggacacagaactgccggctgtggacgaggcgggcgaggccgcggcagatctcaggtattccatgatttgggcccgttgaaactctgtccagccaaacggtgctgcacgcaataa

SEQ ID NO: 97 - protein, 520 aa, Chlorella vulgaris
MAAASGYGSDEEVYATARAVDDAEYGDSDSGAPLDKKKIEPLPPLDHATVEYEDFAKVFYDEHPAMTAMTHAEVTALRARVGIRVSGFDAPKPVQTFEQCGFDGMLMGVIKKAGYQKPTPIQAQALPAALAGRDILGIAKTGSGKTAAFVLPMLVHIMDQPELEKGEGPIGIIVAPTRELSEQIHKETRRFSKPYNLRVCAAFGGLSKYDQFKDLKAGAEVAVCTPGRMIDLIKMKACMCTRVTYLVFDEADRMFDMGFEPQVRSIIGQVRPDRQTLLFSATLPNKIDRLVQDALTSPVRVTVGEIGAANDDISQVAEVLDDSAKWTWLQANVQSFIDQGDVLVFVSTKVRAEEISGQLQAAGLKAAAIHGDMDQHTRMQVLHDFKAGKHHALVATDVAARGLDIKSIKTVVNIDAAKDIDTHVHRVGRTGRAGDKDGVAYTLVTPREARFAGELVNSLAAANQQVPKALMDLAAKDGHFRKAGHRTAGCGRGGRGRGRSQVFHDLGPLKLCPAKRCCTQ

SEQ ID NO: 98 - DNA, 2964 bp, Chlorella vulgaris
atggctgagagggccagatcagagagggatgcggggacatcaaacgaccggcacagggacaaggagaggcgacgcgagtcgcggagggagtacgccgacagccgcggtcggtgtctgtctggcttcagggagaaggacagtgacgggcatagggagaagaagaggcgctcggaaatcccagagacccgggatgcagccgacgagcggcaaaaggccaagcaggtttgcggcaggaaatcaaactttccttcactcctgtcaactcagaattgcgggctgatgttttgtgctgcactgtgggcacaggaggaggagcaggcagcactagacgatgaagcagagcggcggcgcaagcgcgtgcaggcgtggcaggagcagaaagccaagcagatggctgaagaggaacaggccgtcaaggacgccgctgaagaggctgtccagtggacctttgaggacgactccgatgaggacactgcggccggaggcgtgcgcgcggcagacggcgcggcagacgaggcggcggccgcaccgatggagttggacgacgaggtcgatccgctggacgcgttcatgagccagaacgatacgcacgtgacggcgctgatcaagcaggcgcaggagaaggtcgaggaagtggaggaggagattgaccctctggacgccttcatggcagctgaggtgctgccagccgtgacccagaacggcctcagcagaatgccccaggcccagtccagcgagatggtgcaagccgagggagcgggcgagagcgaggcagcgctgccgccgccggccgcaaagcgccggggcccggccgcgcggcggcggtcgcggtacgattccgagtcggactctgacgacgaagaggactgggacgtcgaggaagacgacgcggactgggcgaagaacacgctggcgggcaagctgagcaagagcgacaagctgggcgtggtggaccacagcaccgtcagctacccgcccttccgccgcagcttctacaccgagaccggcgccctggccaggatgaccgaggaggaggtggcagcctaccgcaaggagctcgaagacatcaaggtccgcggcaaagacatacccacgccggtgaagaactggaaccagtgtggcctgagcagccgcgtgcttgacgtcctacagaagggcggctttgcgcggccaatgcctattcaggcgcaggcgctgccggccatcatgagcggtcgcgactgcatcggcatcgccaagaccggctctggcaagacgctcgccttcgtgctgcccatgctgcgccacatcaaggaccagccgccgctggcgcagggagacgggccgatatcgctggtaatggcgcccacgcgcgagctggtggtgcagatcggcaaggacatccgccgcttctccaaggccctcgccctctccgtcgtctgcgcctatgggggctccgccgtcgccggccagattgccgacctcaagcgcggcgccgaggtggtggtgtgcacacccgggcgcatgattgatctgctggcaaccagcggcggcaagatcacaaatttgcgccgcgtgacgtacctggtcatggacgaggcggaccgcatgtttgacatgggctttgagccgcagatcatgcgcatcgtccacaacatccgccccgaccgccagaccgtcatgttctccgccaccttcccccgcgcggtggaggtgctggcgaagcaggtgctggagagcccgatagagatccaggtgggcggccgcagcgtggtcaactcggacatcagccaatcggtggagatccggcccgaggaggaccgcttcctgcgcctgctggagatcctgggggagtggtacgagcgcggcaagatcctcatcttcgtctccagccaggaccagtgcgacaacctcttccgagacctcatcaaggtgggctacccgtgcctgtcgctgcacggcggcaaggaccagagcgaccgtgaatccaccatcaatgacttcaagtcggacgtgtgcaacctgctggtggccaccggcgtggccgcgcgcggattggacgtcaaggaactagtgctggtggtcaactatgacacccccaaccaccatgaggaatacgtgcaccgcgtcggccgcaccggccgcgcgggcaacaagggcacggcgataacgtttatagcgcccgacgatgagaagtacgcgcccgacctggtcaaggcgctgcgcgagtcgggcgcgccggtgcccaaggacctgcaggcgctcgccgactccttcgcgctcaagcgcaaggccggcacggtgcaggcgcacggcagcggctacggcggctcgggcttcaagttcgacaacgaggaagaagaagagcgcaaggccctgcgcaaggtggccaaggaggcgggcatgtcgagcgatgaggaggaagcggacgagagcgaggtgcgcaaggtcatgcccggggaggccgccgcggccgccctcgccgccgccaacgcaaccgccaatgcactcaacactgcggtgcgcacagtccctgctcgatgtgcaccgaaggttgctgaatgtattcgtgtgtgtgtgcagcatggcatgccggtcacgccgatgcagcagatgccggcgtaccctcaggcgcccagcatgtgggccgcaccgggcagccagctgccggccgggccccacttcgaggcagagctggagatcaacgagttcccccagcacgctcgctggaaggtgacgcaccgcgacacgatagcgcagctgaacgagttgacgggcgcggcggtgacgaccaagggcttctacgtggcgcccaaccagcagccgccggagggcgagcgcaagctctacctgctcatcgagggccccaccgaggccaaggtccgcgaggcaaaggccgagatcaaacgcatcctcgaggagttcaccgagaaggccatgcgccgcgacgccgccccccagccggggagatacaccgtcacctga

SEQ ID NO: 99 - protein, 987 aa, Chlorella vulgaris
MAERARSERDAGTSNDRHRDKERRRESRREYADSRGRCLSGFREKDSDGHREKKRRSEIPETRDAADERQKAKQVCGRKSNFPSLLSTQNCGLMFCAALWAQEEEQAALDDEAERRRKRVQAWQEQKAKQMAEEEQAVKDAAEEAVQWTFEDDSDEDTAAGGVRAADGAADEAAAAPMELDDEVDPLDAFMSQNDTHVTALIKQAQEKVEEVEEEIDPLDAFMAAEVLPAVTQNGLSRMPQAQSSEMVQAEGAGESEAALPPPAAKRRGPAARRRSRYDSESDSDDEEDWDVEEDDADWAKNTLAGKLSKSDKLGVVDHSTVSYPPFRRSFYTETGALARMTEEEVAAYRKELEDIKVRGKDIPTPVKNWNQCGLSSRVLDVLQKGGFARPMPIQAQALPAIMSGRDCIGIAKTGSGKTLAFVLPMLRHIKDQPPLAQGDGPISLVMAPTRELVVQIGKDIRRFSKALALSVVCAYGGSAVAGQIADLKRGAEVVVCTPGRMIDLLATSGGKITNLRRVTYLVMDEADRMFDMGFEPQIMRIVHNIRPDRQTVMFSATFPRAVEVLAKQVLESPIEIQVGGRSVVNSDISQSVEIRPEEDRFLRLLEILGEWYERGKILIFVSSQDQCDNLFRDLIKVGYPCLSLHGGKDQSDRESTINDFKSDVCNLLVATGVAARGLDVKELVLVVNYDTPNHHEEYVHRVGRTGRAGNKGTAITFIAPDDEKYAPDLVKALRESGAPVPKDLQALADSFALKRKAGTVQAHGSGYGGSGFKFDNEEEEERKALRKVAKEAGMSSDEEEADESEVRKVMPGEAAAAALAAANATANALNTAVRTVPARCAPKVAECIRVCVQHGMPVTPMQQMPAYPQAPSMWAAPGSQLPAGPHFEAELEINEFPQHARWKVTHRDTIAQLNELTGAAVTTKGFYVAPNQQPPEGERKLYLLIEGPTEAKVREAKAEIKRILEEFTEKAMRRDAAPQPGRYTVT

SEQ ID NO: 100 - DNA, 3315 bp, Glycine max
atggatgagggaaagcataaatcgaggaaagaaaatcatgaggtgaaagatggggattctaagaggagtcaccgtgaccgtgatagaactggagaaaggggtaaggataaaaacgatgggaggcacagagatagggagaagagggatcgtgagtcccgaagacctgagagagagaggagtactgattctgaagacaggtatgatagagacagggagaagcgcaaagataaagataaggatgtggaccgagaaagaagtcgagataagaaaagggaaagggataggacagacagagtaagggagaaagaaagagagagggaaagaaaagaagataaggagaggatcagagagagggaaagggaaagggaaaggagggatcatgagagagagaaggaaaaggaaagagaaagggggaggagagtacgagggagggagaagcgtagggaagttgatagtgattgcagtgatggtgaatctaaggagcaggacagaaagcggcataggaaagaggatggtgattacaagagagagagggaaaggagtgtcagcaagccaagcaggaaatctgaggaacatgaaggaagcccaagaaaaaagagtggcgaagatgattcagataccaaagatgaagagaaaaaacctacccgtgaagaggagatggaggatgaacaaaagaggttggatgaagaaatggaaaagcggaggaggagagttcaagagtggcaagagctaaggaggaagaaggaagaagcagaaagagaaaaacaaggtgaagcaagtgctaatgaacctgagtctggaaagacctggacacttgaaggggaatctgatgatgaagaaggactgggtactgggaagcagacaggtatggatgtagatgaagatgacaaacctgctgatgaggagcctaaggatgtgatggtggtagatactgataatgggacaattgcatctgatttacaggatggaactgctggtgctcctgaagatgaggaaatagatccattggatgctttcatgaattctatggttctacctgaagttgaaaagctaaacaatgctgtgacatcgtcactttctgataaagccattgatgtaaaacccaaggataaagggaatgggcaaaatcgtggtgcacagtcaaggaaaggttcaaataagtctattggcagaataattcctggtgaagagtctgactcagattatgcagatgatgaagttgagaaggatccattggatgaagatgatgatgagttcatgaaaagagtgaagaagacaaaagccgagaagctttctttagttgaccactcaaagatcgactatgaaccattcaagaaaaacttttatattgaagtgaaggagatctcaaagatgactcctgaagaagctgcagtatacaggaagcagttggagttgaagatacatggaaaggatgtgccaaagccaataaaatcatggcaccagactggacttcctagcaaaattttggagaccataaagaagatgaactttgaaatgccgatgcctattcaagctcaggcgctccctgtaatcatgagtggtcgagattgcatagggattgctaaaactgggtcaggcaaaacacttgcttttgttctgccaatgctgaggcatatcaaggatcagccaccagttgttgccggagatggacctattgggctcattatggcccctacaagggaacttgtgcaacagattcacagtgatataaagaaatttgccaaggtactgggtctcaggtgtgtgcctgtgtatggaggatctggtgttgctcaacaaattagtgagttgaaacgtggtgctgagatagtggtttgtactccaggtaggatgattgacatactatgcaccagtagtggaaaaataactaacttgcgtagagtcacttatctggtaatggatgaggctgatcgaatgtttgacatgggttttgaacctcaaatcacacgaattgttcagaatattcgtccagatcgtcaaacagttctgttctctgcgactttcccccgtcaggttgaaatcctggctcgtaaggtcttgaataaacctgttgaaatacaagttggtgggaggagcgttgtgaacaaagacataacacagctagttgaggtgaggccagataatgaaaggttccttagactcttagaaatattgggggaatggtatgagaaaggaaagattttgatatttgttcactcacaggagaaatgtgatagtttgttcaaagatctgctcaggcatggttatccatgcctttctcttcacggggctaaggaccagacagaccgtgaatccacaatatctgattttaaaagcaatgtctgcaatttgttggttgcaaccagtattgctgccaggggattagatgttaaggagctcgaattggtgatcaattttgatgttcctaaccactatgaagattatgtacatcgtgttgggcgcaccggacgagctggccgaaagggttgtgccattacatttatttctgaggaagaggcaagatatgcacctgatctgctgaaagccttggaactatctgagcagattgttccgaatgatctgaaagctcttgctggtagctttatggcaaaagtgaatcaaggactggagcaagctcatgggactggttatggaggcagtggctttaaatttaatgaagaggaagatgaggtgaggaaagcagcaaagaaagcacaagccaaggagtatgggtttgaagaagaaaagtcagattctgaagatgaagatgaaggtattaggaaggcaggaggtgatatctcacagcattctgcttttgcccagattattgctgccactaaagggaatgctcctgcattgcctactccaatactcctaccatccttgcaagtcttgcctgggacagggctacctcttcctgcaaacgatggggcagctcgagcagcagcaatagctgctctaaacttgcaggacaagttagataaaatacgatcagaagcattaccagagcattatgaggctgagttggaaataaatgatttcccccagaatgctcgctggaaggttacacacaaggaaactttgggccctatttctgaatggagtggagctgccattaccactagggggcagtttttcccacctggcaaaatcccaggacctggggaacgcaaactctacttgttcattgaaggtcctactgagcactccgttaagtcagctaaagcagacttgaagcgtgttttggaagacatcacaaatcaggctttgcaacttcctggtggaactcaaccgggcaaatactctgttgtgtaa

SEQ ID NO: 101 - protein, 1104 aa, Glycine max
MDEGKHKSRKENHEVKDGDSKRSHRDRDRTGERGKDKNDGRHRDREKRDRESRRPERERSTDSEDRYDRDREKRKDKDKDVDRERSRDKKRERDRTDRVREKERERERKEDKERIRERERERERRDHEREKEKERERGRRVRGREKRREVDSDCSDGESKEQDRKRHRKEDGDYKRERERSVSKPSRKSEEHEGSPRKKSGEDDSDTKDEEKKPTREEEMEDEQKRLDEEMEKRRRRVQEWQELRRKKEEAEREKQGEASANEPESGKTWTLEGESDDEEGLGTGKQTGMDVDEDDKPADEEPKDVMVVDTDNGTIASDLQDGTAGAPEDEEIDPLDAFMNSMVLPEVEKLNNAVTSSLSDKAIDVKPKDKGNGQNRGAQSRKGSNKSIGRIIPGEESDSDYADDEVEKDPLDEDDDEFMKRVKKTKAEKLSLVDHSKIDYEPFKKNFYIEVKEISKMTPEEAAVYRKQLELKIHGKDVPKPIKSWHQTGLPSKILETIKKMNFEMPMPIQAQALPVIMSGRDCIGIAKTGSGKTLAFVLPMLRHIKDQPPVVAGDGPIGLIMAPTRELVQQIHSDIKKFAKVLGLRCVPVYGGSGVAQQISELKRGAEIVVCTPGRMIDILCTSSGKITNLRRVTYLVMDEADRMFDMGFEPQITRIVQNIRPDRQTVLFSATFPRQVEILARKVLNKPVEIQVGGRSVVNKDITQLVEVRPDNERFLRLLEILGEWYEKGKILIFVHSQEKCDSLFKDLLRHGYPCLSLHGAKDQTDRESTISDFKSNVCNLLVATSIAARGLDVKELELVINFDVPNHYEDYVHRVGRTGRAGRKGCAITFISEEEARYAPDLLKALELSEQIVPNDLKALAGSFMAKVNQGLEQAHGTGYGGSGFKFNEEEDEVRKAAKKAQAKEYGFEEEKSDSEDEDEGIRKAGGDISQHSAFAQIIAATKGNAPALPTPILLPSLQVLPGTGLPLPANDGAARAAAIAALNLQDKLDKIRSEALPEHYEAELEINDFPQNARWKVTHKETLGPISEWSGAAITTRGQFFPPGKIPGPGERKLYLFIEGPTEHSVKSAKADLKRVLEDITNQALQLPGGTQPGKYSVV

SEQ ID NO: 102 - DNA, 2172 bp, Ostreococcus lucimarinus
atgaacgaggtcttcgactcaagcggaggcgagtcgtccgaagacgaagccgaaagagatgaagctaaaactacggatgttctgtcggaagacgcggtcgaagcaaaaactgaggtagatgacgacgacgacgacgacgaagcgtgggcaaagaagcaaaccgcgaaattgagcaagactgaacgtctcgggacggtgaatcacgacgagatcgattacgaaccggtgaagaaaaacttttacatcgaagcgaaggaaatagcgtcgatgaccaaggcggaggtgaagcagcttcgtgtggagttggacggaatcaagtgtcgaggtaaaaaggtgccgaaacccatcaagacgtgggcgcaggcgggcttgaacaatcgcgtgcatgagctgattcgccggtctggattcgaaaagccgatgcctattcaggcacaagcgcttcccgtgatcatgtccggacgcgattgcatcggggtcgcgaaaaccggtagcgggaagactttagcgtacattttaccgatgttgcgccacatcaacgcgcaggagcccctcgcctccggcgacggacctattggtatgatcatgggacctacgagagagttggtgacgcagattggtaaagattgcaagcgttacggaaaagccatggggttttcggccgtgtccgtgtacggtggctcgggtatagcggcgcagattggcgatttgaaacgcggcgcggaaatcgtcgcgtgcacgcccggtcgcatgattgacttgctgacgacaggttcgggaaaaattacaaacttgcgtagagtaacttacatggtgctcgatgaggcagaccgtatgttcgatatgggctttgaaccacaaattactcgcatcctggccaatcttcgtccggatcgccagacggtgatgtttagcgccacgtttccgcacacgatggaggcgttggcgcgtgccgcgctggacaacccgatcgagatccaaatcggtggaaagtccgtggtgaactccgatatagagcagcttgtggaacttcgtcccgaagaagatcgatttttacgagtcttagaattactcggcgaatggtacgagcgcggcaagattataatcttcgtcgcgagccaggacaaggcggactcgactacgatttcagacttcaaatcagacgtctgtaacatcctcgtcgccacctccgtcgccgctcgcgggttggatgtcaaggatttgaggctcgtcatcaactacgacacgcctaaccacttggaggattacgtgcacagagttggacgtactggacgcgccggccagaaagggaccgcagtaacgtttatttcagaagacgaagaaaagttcgcacccgacttagtcaaggcgcttaaagagtcgaagcaaaacgtcccgcaggatgtgcaagcaatggcggatgagtttactcgtaagcgcaaggagggtctcgtcggtgccgctggttctggcttcggtggttctggattcaaattcaaccaagaagagcaagacctcttgcgcaaacagaagcgtgacgccgctcgagcggctggcctggatgtagacgatggtgagagcgatagtgacgaagagccagctgcgcacacgccaggagcgctcgtcgccaagggtggcttgacgcccgcgcagatcgcgcaagctgcggcgcaatccgtttttgcaaaaatgaagcagccgcaaaaacaagctgcaggcgcgcaaaatacgaaagcgatcgcattggctcagagctacgcgcttgcgcacggcgcatcggcgggtgccgctaaagccgccgccctcgccgcagcgctcaacgcgcagcacgcaaaaacgtccagagggccgacgcagtcaggctcgcacttcgagactgagctcgagatcaacgacttcccacaattcgcgcgctacaaggtcactcacaaagacacgttagtgcaaatcatggagcataccggcgccgcagtcacggcaaaagggcaatacgccgcccccgggcgtccgctcgcccccggcgatcgcaagctctacctcctcatcgaaggccccaccgagcgcgtggtcaaggaaggaaagaactacgtcaagaacatcatcgagaccgccatcgctaagcaagcccttcccggcgccgcaggtcaaccacaaggccgttatcgcatctag

SEQ ID NO: 103 - protein, 723 aa, Ostreococcus lucimarinus
MNEVFDSSGGESSEDEAERDEAKTTDVLSEDAVEAKTEVDDDDDDDEAWAKKQTAKLSKTERLGTVNHDEIDYEPVKKNFYIEAKEIASMTKAEVKQLRVELDGIKCRGKKVPKPIKTWAQAGLNNRVHELIRRSGFEKPMPIQAQALPVIMSGRDCIGVAKTGSGKTLAYILPMLRHINAQEPLASGDGPIGMIMGPTRELVTQIGKDCKRYGKAMGFSAVSVYGGSGIAAQIGDLKRGAEIVACTPGRMIDLLTTGSGKITNLRRVTYMVLDEADRMFDMGFEPQITRILANLRPDRQTVMFSATFPHTMEALARAALDNPIEIQIGGKSVVNSDIEQLVELRPEEDRFLRVLELLGEWYERGKIIIFVASQDKADSTTISDFKSDVCNILVATSVAARGLDVKDLRLVINYDTPNHLEDYVHRVGRTGRAGQKGTAVTFISEDEEKFAPDLVKALKESKQNVPQDVQAMADEFTRKRKEGLVGAAGSGFGGSGFKFNQEEQDLLRKQKRDAARAAGLDVDDGESDSDEEPAAHTPGALVAKGGLTPAQIAQAAAQSVFAKMKQPQKQAAGAQNTKAIALAQSYALAHGASAGAAKAAALAAALNAQHAKTSRGPTQSGSHFETELEINDFPQFARYKVTHKDTLVQIMEHTGAAVTAKGQYAAPGRPLAPGDRKLYLLIEGPTERVVKEGKNYVKNIIETAIAKQALPGAAGQPQGRYRI

SEQ ID NO: 104 - DNA, 3150 bp, Oryza sativa
atggggtctagcgacgaggccggctcctccaagcaccaccgccgcgacaaggagaaggaccgcgagcggtcctcctcccgccaccaccgcgaccgcgaccgcgagagatcctcctctcgccaccaccaccgcgaggaccgggatgacgaccgggatcgggaccgggaccgggagcgccgccacagggagaaggagcgggatcgcgaggagcggaaggcgcgggagcgggaggagcgggagaaggagaaggagagggagcgtgcgcggcggcgcgaggagagggaccgcgaggagaggtcgaggaggcgggaggcggcggcggaggaggaggaggaggatgtggaccgcgaccgcaagcgccgccgccggtcgtcgcaccaccaccaccaccaccgcgacgcggagccggaggggccggcttcgggggccagggaggaggaggtggtggatgtggaggaggccgagaggcggcgccagaagaagaaggaggaggagcagaagcagctggacgaagagatggagacgcggcgccgccgcatcaaggagtggcaggagatgaagcgccgcgaggaggagacgaagcgccgcgagcaggaggaggccggagttggcacctcagccgccgccgccgcggcccccgcagaagcagaagatggcggcaatgccgggaagaagtggaccttggatggcgaggagtctgatgaggaggggaaccaagaggatggtaagaaatccgatgataatggtggttctggtgccggtgccatggacgttgatgttccaaatgggggtgataatgcaaacggcgccaatgctatggatgaagatgagattgatccgcttgatgcgttcatgaactcgatggtattgcctgaggtcgcaaagcttgagagcatgcctgctgccaatgtggatgacaagaatgataagagtgctaaggatgctgtgactaatggggataaaaaggggccaaagaaggtgatggggagaattatacaaggagaagactcagactcggattatgcagatgacgaggatgatgagggtggttccgaagatgaggatgatgaggagttcatgaaacgtgtcaagaagacaaaggcagaaaagttggctattgttgaccattctaagatcgactaccagccgttccggaagaatttctacattgaggtgaaggatattacaaagatggcagctgaggaagtggcagcttatcggaagcagttggagctcaaggtgcatgggaaagatgtacccaagccaataaagacatgggtgcagagtgggcttaccagcaagctccttgatacaatcaagaaacttggtttcgagaaaccgatgtctatacaggcacaagcactgccgatcataatgagtgggcgtgattgtataggaattgcaaagactggatcaggcaagactctagcatttgtcctgcctatgctgaggcatgtcaaagatcagccggctgttgttcctggagatggcccaattgggcttataatggctcctactagagagcttgtggtgcagatacattcagacattaagaagttttcgaaggcgcttggcatcaactgtgttgctatctatggaggttctggagttgcccagcagatcagtgaactgaagaggggtgctgaaattgttgtttgtacaccaggcaggatgattgatattctttgcacaagcagtgggaagattactaatcttcggagagttacattcttggtgatggatgaagctgataggatgtttgatatgggttttgagcctcagattactcggatagttcagaatactcgtccagataggcagacagttcttttctcagccacttttccacgtcaggtggagatactggcccgtaaggtgctgacaaagcctgttgagatccaggtgggtgggaggagtgtcgtcaacaaagatatcacacaactggttgaggtgcggccagaaaatgagaggttctttaggctgttggagctgcttggagagtggtttgataaaggtaaaattcttgtttttgtccattcacaagataaatgtgattctctactcaaagacctgttccagcatggatatccatgcctatccctgcatggtgggaaagaccagactgaccgtgaatcaacactagctgatttcaagagcaatgtgtgcagcttgctgattgctaccagtgttgctgctaggggtttagatgtcaaggagcttgagcttgttgtgaattatgatgtcccgaaccactatgaggattatgttcatcgtgttggacgaactggacgtgctgggaggaagggatttgccgtgacttttatttctgaggaagaggagcgttatgctccagaccttgttaaagctttggagctctcagagcaggctgttccagaggacctgaaaggtctagctgatcgttttatggcaaaggtgaagcagggaacagagcaggcccatggaacaggatatggtggaagcggtttcaagttcaatgaagaggaggatgaagcacggaaatctgcaaagaaggctcaggcaagggaatatggttatgaggaggacaagtcagattcagattctgatgaggaaggaggggttcgtaaggcgggaggtgaccttgcggcacaagctattgctgctgctcaagctgctgctgctatggttgcagcaaaggctgctagcaatgccaaccagcaaacacaaggcacttctgtagggcccttgcttcctctagccattgcttcaaacacacagaataacgaggccacagcacgtgcactgcaggctgcatttaacatacagcaaaatctggcaaggatacaagcacatgcagtcccagaacattatgaggctgagcttgagattaatgatttcccacaaaatgcccgctggaagatcactcacaaagaaacattgggtcctatccaggaatggacgggtgctgcaatcactacaaggggaaccttttttcctcaaggaaaaattgttggtgctaatgaacgcaagctgtacctgttcatagagggccccactgagctatctgtcaagaaggcgaaagcagaattgaagcgtgtccttgaagattgtgccaaccatgctctgaaccttcctggttctgcccaaactggaaagtactctgttatttga

SEQ ID NO: 105 - protein, 1049 aa, Oryza sativa
MGSSDEAGSSKHHRRDKEKDRERSSSRHHRDRDRERSSSRHHHREDRDDDRDRDRDRERRHREKERDREERKAREREEREKEKERERARRREERDREERSRRREAAAEEEEEDVDRDRKRRRRSSHHHHHHRDAEPEGPASGAREEEVVDVEEAERRRQKKKEEEQKQLDEEMETRRRRIKEWQEMKRREEETKRREQEEAGVGTSAAAAAAPAEAEDGGNAGKKWTLDGEESDEEGNQEDGKKSDDNGGSGAGAMDVDVPNGGDNANGANAMDEDEIDPLDAFMNSMVLPEVAKLESMPAANVDDKNDKSAKDAVTNGDKKGPKKVMGRIIQGEDSDSDYADDEDDEGGSEDEDDEEFMKRVKKTKAEKLAIVDHSKIDYQPFRKNFYIEVKDITKMAAEEVAAYRKQLELKVHGKDVPKPIKTWVQSGLTSKLLDTIKKLGFEKPMSIQAQALPIIMSGRDCIGIAKTGSGKTLAFVLPMLRHVKDQPAVVPGDGPIGLIMAPTRELVVQIHSDIKKFSKALGINCVAIYGGSGVAQQISELKRGAEIVVCTPGRMIDILCTSSGKITNLRRVTFLVMDEADRMFDMGFEPQITRIVQNTRPDRQTVLFSATFPRQVEILARKVLTKPVEIQVGGRSVVNKDITQLVEVRPENERFFRLLELLGEWFDKGKILVFVHSQDKCDSLLKDLFQHGYPCLSLHGGKDQTDRESTLADFKSNVCSLLIATSVAARGLDVKELELVVNYDVPNHYEDYVHRVGRTGRAGRKGFAVTFISEEEERYAPDLVKALELSEQAVPEDLKGLADRFMAKVKQGTEQAHGTGYGGSGFKFNEEEDEARKSAKKAQAREYGYEEDKSDSDSDEEGGVRKAGGDLAAQAIAAAQAAAAMVAAKAASNANQQTQGTSVGPLLPLAIASNTQNNEATARALQAAFNIQQNLARIQAHAVPEHYEAELEINDFPQNARWKITHKETLGPIQEWTGAAITTRGTFFPQGKIVGANERKLYLFIEGPTELSVKKAKAELKRVLEDCANHALNLPGSAQTGKYSVI

SEQ ID NO: 106 - DNA, 2226 bp, Physcomitrella patens
atgtcgaagcgaaggtttggatttgagggtttcggaataaacaaaaagacgaactacgacttcgaggcgcaacctgccaagccgcgtctgtatttgccttctccgcggaacaggcgatctgagtatgttgaggatcatgatttggataatattggctcagaggacgatgggcgcgaatccgagaattttaggaacagggacgaaaataataatgcggggagtggcgcagtgcctgacaacgacgatgaagtcgatccacttgatgcatttatggaaggcattcacgaggaggtaaagaaagcacccgtgaagcccagacctatagttgaagaactggaggacgatgaggatgatccaatggagagttttctcaaggctcgacgggatgcaggactttcattggctgctgaagccttgcatgctggttatgatactgatgaggaagtttatgctgctgcgaaggcagtcgataatggacagattgagtacgactctgatgacaatgcgattgtgactttggagaaaaagaaaattgaagctcttgctcctctagaccacaatgacgttgattatgaaaagttttctaaggatttctatgaagagtcagattcaatttcaggtatgactgaagaggaagttgctgcctatcgcaattcactagctatcagagtatcaggatttgacgtttctagacctgtcaagacgtttgaagacctaggcttcgacgcctccctgatgggtgcaatatcaaaacagggttacgaaagacctactccaatccaatgtcagtcttgtccaatagttttgtcgggtcgagatttgataggaattgctaagacaggatcaggaaagacagcagcctttgttctgcctatgatggtacatattatggatcaaccagagcttggcaagggcgaaggtccaattggtgttatttgtgcaccaacacgtgagcttgcacaacaaatctactcggaggctaagaaattcgccaaggtacatggtatcagaatttccggagtctatggtgggatgtcaaagtttgagcaatttaaagaactgaaggctggatgcgaggtcgtggttgctactcctggacgcttgatagacatgattaagatgaaagcgttgtcaatgcatcgggcaacatatctcgttctcgatgaggccgatcgcatgttcgatttaggttttgaacctcagattcgatctattgtcggtcagatcagacctgaccgccagacgttactattttctgctacaatgccgaagcgagtggagcgtcttgctcgtgagattttgacagatccaatcagggtcactgttggtgaaattggtagtgcaaatgaagatatcactcaggtcgtcactgttctgccttccgacgccgagaaaactccttggttgctcgacaggctgcaaccctttgtagatgatggagatgttttggtatttgcgtccactaagttaagagtggaagagctagagggaaagatttcagaggcaggatttaaagtcgctgctcttcatggagacaaggatcaagctacaagaatggaagtcttgcagaaatttaaaaatgggatttatcatattcttgtagcaactgacgtagcggcccgcggcttagacattaagtccatcaaaacggttgtgaacgttgatattgctagagatatggacagtcatgtgcatcggattggacgcacaggaagagctggtgacaaagatggggtggctcatacacttgtgacaggaaaagaagcccggtttgctggtgagcttgtgaatagtctcatagctgcaggacaaaatgttcccacggagctgatggaccttgctatgaaggatggtcgttaccgtgctcaacgagaaggacggcggcgtggtggagggcaggggaaaggtggacgaggtggaggtcggaatgttcgaggtgtagactttggcttaggaattggttatagtgctgatgctgcaaatgcagcgcctagtaaagaagatattccctcacgaggcagtgctgtagattctctgagacaagggatgatggctcgatttaagagtaatttcgttgcagctaatacacccaactctgtaggctacaccccacctcaagccaacactccacaagggcgtgtttacggtgccccaccaagtgtcaacgggaagggtcgcggaaactttgtatctgctggtaggttttctttgttagttgcgatttga

SEQ ID NO: 107 - protein, 741 aa, Physcomitrella patens
MSKRRFGFEGFGINKKTNYDFEAQPAKPRLYLPSPRNRRSEYVEDHDLDNIGSEDDGRESENFRNRDENNNAGSGAVPDNDDEVDPLDAFMEGIHEEVKKAPVKPRPIVEELEDDEDDPMESFLKARRDAGLSLAAEALHAGYDTDEEVYAAAKAVDNGQIEYDSDDNAIVTLEKKKIEALAPLDHNDVDYEKFSKDFYEESDSISGMTEEEVAAYRNSLAIRVSGFDVSRPVKTFEDLGFDASLMGAISKQGYERPTPIQCQSCPIVLSGRDLIGIAKTGSGKTAAFVLPMMVHIMDQPELGKGEGPIGVICAPTRELAQQIYSEAKKFAKVHGIRISGVYGGMSKFEQFKELKAGCEVVVATPGRLIDMIKMKALSMHRATYLVLDEADRMFDLGFEPQIRSIVGQIRPDRQTLLFSATMPKRVERLAREILTDPIRVTVGEIGSANEDITQVVTVLPSDAEKTPWLLDRLQPFVDDGDVLVFASTKLRVEELEGKISEAGFKVAALHGDKDQATRMEVLQKFKNGIYHILVATDVAARGLDIKSIKTVVNVDIARDMDSHVHRIGRTGRAGDKDGVAHTLVTGKEARFAGELVNSLIAAGQNVPTELMDLAMKDGRYRAQREGRRRGGGQGKGGRGGGRNVRGVDFGLGIGYSADAANAAPSKEDIPSRGSAVDSLRQGMMARFKSNFVAANTPNSVGYTPPQANTPQGRVYGAPPSVNGKGRGNFVSAGRFSLLVAI

SEQ ID NO: 108 - DNA, 3219 bp, Physcomitrella patens
atggggagagataagtaccgggatcgtgagaaggattatggagacaaggagcattgggagcgagagagagacaaggagcgtaagcaccgggagcgggagaagcgaggagatagggatttggagaaggagcgagacgagaggaagcgaagtaggcgtgatgatgatggagtggaggtcaaggacaaggaaaaggagcgcgaccgaaaggggggagagagagatagggagggtaaaaaggagagggatagagagcgcgagcgtgagagggaggctgaggaggagcgggatcggaaacgaaggaagaaggatgaggatgagagcagggagagggaagaaatcagggagaaagaggagcgtgagcgtgagcgtgagaaggagaggttgcgggagagagagaaggaacgagatagagaagaagagagggagaaatcgagagaaagagagcgtgaacgagaaaaatcgagagacagagataaggataaagaaaaggagaaggatagggaaaagggaagggacaaacacagagagagaaccagagacaaggatagggatcgagaacgtgacctaagaagtggtgaaggagatagggatcgggatagaaagaggagaaggaaggaagaggacgcagcacgagatgatttgaaagtgaaaaaagatcctgaaaacgatgaggaccctgaagaggagcagaagagactcgatgaagagattgataagagacggcgaagagtgcaggagtggcaagaattgcgtcggcggaaagatgaagaggaccgacagaagcgagaatcggtgcaggccgatgcggacgttgtatcttcgcctaagaacgcgaagaagacttggactttggaaggtgaagattctgatgatgaggaggatgcagttttgccgaagtctgggggcacaacagcttctagagtagctgccttcgacaatggagacttagttatggctgatttcggtggtaatggaatggaggaggaggaagagatcgatccacttgatgcattcatgaactcgatcaccatcccagaggtgagtagtaccgatgctgtggaattggatgctccggaatccaaaccaatagttgcgaagtcgggttctggaaaaggtcaggataatgttaaacctgttaagcgaaataataggaacactctcggccgaatcatgcccggtgacgattctgcctccgaggatgaagatgatggagaaggtgatgaagatgacgacgagtttttgaagagggttaaaaagaccaaagcagagaaattggctattgtggaccattcaaagatccagtatccttccttccgtaaaaatttctacatcgaggtcaaggaaatatcccgtatgactaaagcggaagctgaagcatataggaaagagttggaattaaagattagaggaaaggatgtacctcgtccactgaagacgtggaaccagacaggtttgaacagcaaggtcttggatgtaattaagaaatcaggtttcgaaaagccaatgcccattcaaacgcaggcacttccaattattatgagtggaagagattgcattgggattgcaaagaccggttctggtaaaacgttggctttcgtgttgcccatgctccggcacattatggatcagccaccccttcaacaaggggatgggccgataggattgatcatggctccaacaagagagcttgtgcaacaaatatacaacgacattaggaagttctcaaaggtcgtggggttgacatgcgtgccagtatatggcggttcaggtgtagcgcaacagattagcgaccttaaaagaggaacagagattgtggtgtgcacacctggtcgaatgattgatattctttgcacgagttctgggaaaatcacaaatttgcgacgtgtgacttatcttgtgatggatgaagcagatcggatgttcgacatgggttttgaacctcagataactcgcattgtccaaaatactagaccagataggcaaacagtgctcttttcagctacttttcctaggcaggtcgaagttcttgctcgcaaggttttaacgaaacctgtggaaattcaaatcggtggacgaagcgttgttaacagtgacatcacgcagactgtggaagttcgcccagagagtgaaagatttttacgattgcttgagcttcttggagagtggtacgagaaaggaaaaatccttgtttttgtacattctcaagagaaggagtccactatcacagactttaagacaagtgtttgtaacttaatgatagcgacaagtattgctgcgaggggtttggacgtgaaggagcttgagctggtggtaaattatgatgtccctaatcactacgaggattacgtgcatcgtgtgggtcgcacaggtcgtgctggacggaaagggttcgctgtgactttcatatctactgaagaggagaggtatgccccagaccttgtaaaggcattagagctttcagagcagcctattcctgaggatttaaagaaactagcagatgattttatggtgaaagttaagcagggtagcgagcaagctcatggcagtggatacggaggcagtgggtttaagtttaatgaagaggaagatgaggctttaaaggcagccaaaaaggctcaagccagagaatatggttttgaagaagaggaggacaagtcagattcagaatctgatgatgaaggcattcgtaaagcaggtggagaaatgtcatcgcaaattgccaatcagatggcgctggccaatatggcaggtgccatgggtcatcttggttctccaatgttggggatggctgctggcgcatctgctacagcaggattgaccgacgggaatccagctgcacgagcagctgccatggccgctgcgtacaaccttcaaaataatctggcaaagatacaagcagacgtggctcccgagagttatgagatcgagctcgagatcaatgactttcctcagcatgctcgctggaaagttacgcataaggatgctttgggacagatcagtgaatggactggagcagcaattaccactcgaggtcagtattttcctcctggaaaggtcccggcgcctggagaacgcaagctattcttgtttattgagggccctactgaggcctctgttaagaaagccaaggcggaagtgaaacgcattcttgaggaatcaacctcagcggctattcaactcccagggccagctcaacctggaaagtactcagtattgtga

SEQ ID NO: 109 - protein, 1072 aa, Physcomitrella patens
MGRDKYRDREKDYGDKEHWERERDKERKHREREKRGDRDLEKERDERKRSRRDDDGVEVKDKEKERDRKGGERDREGKKERDREREREREAEEERDRKRRKKDEDESREREEIREKEEREREREKERLREREKERDREEEREKSREREREREKSRDRDKDKEKEKDREKGRDKHRERTRDKDRDRERDLRSGEGDRDRDRKRRRKEEDAARDDLKVKKDPENDEDPEEEQKRLDEEIDKRRRRVQEWQELRRRKDEEDRQKRESVQADADVVSSPKNAKKTWTLEGEDSDDEEDAVLPKSGGTTASRVAAFDNGDLVMADFGGNGMEEEEEIDPLDAFMNSITIPEVSSTDAVELDAPESKPIVAKSGSGKGQDNVKPVKRNNRNTLGRIMPGDDSASEDEDDGEGDEDDDEFLKRVKKTKAEKLAIVDHSKIQYPSFRKNFYIEVKEISRMTKAEAEAYRKELELKIRGKDVPRPLKTWNQTGLNSKVLDVIKKSGFEKPMPIQTQALPIIMSGRDCIGIAKTGSGKTLAFVLPMLRHIMDQPPLQQGDGPIGLIMAPTRELVQQIYNDIRKFSKVVGLTCVPVYGGSGVAQQISDLKRGTEIVVCTPGRMIDILCTSSGKITNLRRVTYLVMDEADRMFDMGFEPQITRIVQNTRPDRQTVLFSATFPRQVEVLARKVLTKPVEIQIGGRSVVNSDITQTVEVRPESERFLRLLELLGEWYEKGKILVFVHSQEKESTITDFKTSVCNLMIATSIAARGLDVKELELVVNYDVPNHYEDYVHRVGRTGRAGRKGFAVTFISTEEERYAPDLVKALELSEQPIPEDLKKLADDFMVKVKQGSEQAHGSGYGGSGFKFNEEEDEALKAAKKAQAREYGFEEEEDKSDSESDDEGIRKAGGEMSSQIANQMALANMAGAMGHLGSPMLGMAAGASATAGLTDGNPAARAAAMAAAYNLQNNLAKIQADVAPESYEIELEINDFPQHARWKVTHKDALGQISEWTGAAITTRGQYFPPGKVPAPGERKLFLFIEGPTEASVKKAKAEVKRILEESTSAAIQLPGPAQPGKYSVL

SEQ ID NO: 110 - DNA, 1545 bp, Physcomitrella patens
atgagccgatttgatggccgatatggcgatccttcgtcgtttcgcgacaggaagagagttggtgcaggaggaggcgggcgaggaggttatggtgggagcagcaagcgtgatttggacgacatagcgttgccagcgcaggagttcgaaaacctaattccattcgagaagaatttctacgtggagcatccggccgtgtctgctttgaccgaggaggaggttgcagcttacaggcgaaagcgagaaataactgtggaaggtcggaccgttcctaagcccgtccgcacgttcgaggaggcgtcatttccagattatgtgctgcatgaggtgctgaaggcagggttcacggagccaacagctattcaagcgcaaggctggcccatggctttgaaggggcgcgacttgatcgggctggcagaaaccgggtccggaaaaacactggcatatctgctgccggctattgtgcatgtgaatgctcaaccgtatctggctcctggagatgggccgatcgtgctggtgttggcccctactcgtgagttggcggtgcagattcagcaagagtcgacgaaatttggggcgtcttcgaagatcaagaacacgtgcatatacggaggtgccccgaaagggccacagatccgcgacctgcagaaaggggttgaggttgtgattgcaacaccgggtcgtttgattgacatgctggaaggtcgacacacgaatttgcggagagtgacgtacttggtgttggacgaggccgatcgaatgctggacatggggtttgaaccgcagattcggaagattgtatcgcagattcgaccagatcgtcagacgctgtattggagtgcgacatggccgaaggaagtagagttccttgcgaggcagtttttgaacgatccgtacaaggtgacgattggttcgtcggatctgaaagccaaccatgcgatagaccaagttgtggaggtggtgtcggaacacgaaaagtatcccaagttgatcaagctgttggaagagataatggatggaagcaggttgctggtattcatggagacgaaacgcgggtgcgatcaggtgacgcggcagctgagaatggacggttggcctgcgctgtcgatccatggcgacaagtcccaggcagagagggactgggttttgtcggagttcaaagctgggaagagtcctatcatgacggccactgatgtcgctgcgcgtggtttggatgtgaaggatatcaagtgcgtgatcaactacgactttccgggttcgtgtgaagactacgtgcaccggattggtcgcacaggacgtgctggtgcgaagggagctgcgtacacgttcttcactgcagcgaacgcgaagcacgcgaaggagctggtgtcaatacttgtggaggcgggtcaaccagtgagttctcagttgcaagcaatggtgggcagcagtcggggcggaggcggtggaggatttcatcgtggaaggggtttcggtgggcgaggatttggcgttcagcagtcaggttccaacactatacccctgggcggtcaaagatggggtcggtaa

SEQ ID NO: 111 - protein, 514 aa, Physcomitrella patens
MSRFDGRYGDPSSFRDRKRVGAGGGGRGGYGGSSKRDLDDIALPAQEFENLIPFEKNFYVEHPAVSALTEEEVAAYRRKREITVEGRTVPKPVRTFEEASFPDYVLHEVLKAGFTEPTAIQAQGWPMALKGRDLIGLAETGSGKTLAYLLPAIVHVNAQPYLAPGDGPIVLVLAPTRELAVQIQQESTKFGASSKIKNTCIYGGAPKGPQIRDLQKGVEVVIATPGRLIDMLEGRHTNLRRVTYLVLDEADRMLDMGFEPQIRKIVSQIRPDRQTLYWSATWPKEVEFLARQFLNDPYKVTIGSSDLKANHAIDQVVEVVSEHEKYPKLIKLLEEIMDGSRLLVFMETKRGCDQVTRQLRMDGWPALSIHGDKSQAERDWVLSEFKAGKSPIMTATDVAARGLDVKDIKCVINYDFPGSCEDYVHRIGRTGRAGAKGAAYTFFTAANAKHAKELVSILVEAGQPVSSQLQAMVGSSRGGGGGGFHRGRGFGGRGFGVQQSGSNTIPLGGQRWGR

SEQ ID NO: 112 - DNA, 2688 bp, Populus trichocarpa
atggagaagaggaggagaagagtccaggaatggcaagagctgagaaggaagaaggaagaaactgagagtgaaaagggtggggaagaagccaatgttgatgaatctaagagtggtaaaacctggactcttgaaggagaatctgacgacgaagaagcacctcccactggcaaatccgatatggacattgaccaggaggaaaatgcaatacctgataaagaagctggagatgcaatggtggtggacactgagaatgacatttctgctccacaaagtgaggttgatgctgttaatggggatgaggaaattgatccattggatgctttcatgaattctatggtcttacctgaggttgagatgctaaacaatgctgtggttactcagactgctgatgataataaagcagactcaaagaagaaagataagaatgatgaaggaataaatggaggacagcggaagaaaggctctcataaatctctagggagaattattcctggagaagattctgattcagaccacggggaccttgaaaatagtgaagttcctttagaagatgaggatgatgacgagttcatgaagagggtgaagaaaacaaaagctgagaaactgtccattgttgaccactcaaagattgattacagtcctttccgcaagaatttctatattgaagtgaaggagatcttgaggatgactcctgaggaggttactgcttataggaaactactggagttgaaaatacatggaaaggatgtgccgaaaccaattaaaacttggcaccagacaggactcacaagtaaaattttggagacaataaagaaacttaattatgagaaaccgatgacaattcaagctcaggcactgcctataattatgagtggacgggactgcataggcattgcgaaaactggttctggtaaaacccttgcatttgtgctgccaatgctgaggcatatcaaggaccagcctcctgtagaagctggagaaggaccgattgggcttataatggcgcccacaagggagcttgtgcagcagatccacagtgatattaggaagtttactaaggccctgggtataagatgtgtgcccgtttatggaggttctggtgtagcccagcaaattagtgaattgaaacgggggacagagatagttgtctgtactccaggcaggatgattgacatactttgcaccagtggagggaaaatcaccaatcttcgtagagttacatatctggttatggatgaagccgaccggatgtttgacatgggattcgaacctcaaatcactagaattgtccaaaatattcgtccagatcatcaaactgtactcttttctgccactttccctcggcaggttgaaactttggctcgtaaagtactgaacaaacctgtggaaatacaggtaggtgggaggagtgtggtgaataaggacatcaatcagctggttgaggtaagaccagaaggtgaaaggtggtttaggttgttagaactacttggtgtatggagcgagaagggaaaaattttggtatttgtccaatcacaggacaaatgtgatgcgttgtttagggacttgctgaagtttggtcatccttgcctctcacttcatggggctaaggatcagacggaccgtgaatccaccatttcggattttaagagcaacgtctgcaatttgttgattgcaacaagtgttgcagccagaggcttagatgtgaaggatctagaactggtgatcaattatgatgttccaaatcattatgaggattatgttcaccgtgttggtcggactggccgagctggtcgcaaaggctgtgccatcacttttttctccgaggatgatgcaagatatgcaccggatcttgtaaaagcattagaactctctgagcaagttgttccacaagacttgaaagcccttgctgatggttttatggtgaaagtgaatcagggtctggagcaagcccatggaactggttatggtggaagtggttttaaattcaatgaggaagaggatgaaaagagaatggcggcaaagaaagcacaagcaagagaatatggcttcgaggaagagaagtctgattcagaagatgaagatgaagttgttcggaaggcaggtggtgacatctcacagcagactgcccttgctcagcagatagctgctcttgctgctgtctcaaaaatccctgcacccgtggcaccaactcctcactctgttactcaatttctttctaatggtggattacctgttcctctcaatcaaggtccagcagttgcatctgtgactgggctgccttttgctcataataatgaagctgcagccagggcagcagcaatggcagccgccatgaatttgcaacacaacctggcaaggatccaagctgatgcaatgcctgaacattatgaagcagagctggaaatcaatgattttccccaaaatgctcggtggaaggttacccacaaggaaactttgggcccaatttcagattggactggtgctgccattaccaccagggggcagtttttcccaccaggcaaggtgccaggaccaggagatcgcaagctgtacctgttcatcgagggccctactgagcagtctgttaagagagctaaagctgatctaaaacatgttttggaagacatcacgaaccaaacatatcaacttcctggtggagctcaaccaggcaaatactcggttgtataa

SEQ ID NO: 113 - protein, 895 aa, Populus trichocarpa
MEKRRRRVQEWQELRRKKEETESEKGGEEANVDESKSGKTWTLEGESDDEEAPPTGKSDMDIDQEENAIPDKEAGDAMVVDTENDISAPQSEVDAVNGDEEIDPLDAFMNSMVLPEVEMLNNAVVTQTADDNKADSKKKDKNDEGINGGQRKKGSHKSLGRIIPGEDSDSDHGDLENSEVPLEDEDDDEFMKRVKKTKAEKLSIVDHSKIDYSPFRKNFYIEVKEILRMTPEEVTAYRKLLELKIHGKDVPKPIKTWHQTGLTSKILETIKKLNYEKPMTIQAQALPIIMSGRDCIGIAKTGSGKTLAFVLPMLRHIKDQPPVEAGEGPIGLIMAPTRELVQQIHSDIRKFTKALGIRCVPVYGGSGVAQQISELKRGTEIVVCTPGRMIDILCTSGGKITNLRRVTYLVMDEADRMFDMGFEPQITRIVQNIRPDHQTVLFSATFPRQVETLARKVLNKPVEIQVGGRSVVNKDINQLVEVRPEGERWFRLLELLGVWSEKGKILVFVQSQDKCDALFRDLLKFGHPCLSLHGAKDQTDRESTISDFKSNVCNLLIATSVAARGLDVKDLELVINYDVPNHYEDYVHRVGRTGRAGRKGCAITFFSEDDARYAPDLVKALELSEQVVPQDLKALADGFMVKVNQGLEQAHGTGYGGSGFKFNEEEDEKRMAAKKAQAREYGFEEEKSDSEDEDEVVRKAGGDISQQTALAQQIAALAAVSKIPAPVAPTPHSVTQFLSNGGLPVPLNQGPAVASVTGLPFAHNNEAAARAAAMAAAMNLQHNLARIQADAMPEHYEAELEINDFPQNARWKVTHKETLGPISDWTGAAITTRGQFFPPGKVPGPGDRKLYLFIEGPTEQSVKRAKADLKHVLEDITNQTYQLPGGAQPGKYSVV

SEQ ID NO: 114 - DNA, 2301 bp, Sorghum bicolor
atgtcgaagcgcccgaagctcgagggtttcagcatcccgcggcccacctcctacaacttcgagcgctcgcagcccgtgcagcggctctaccgtccgacggatgacccggacctcgacgacatcgccttctccgacgacgccccctcagatgcccccgccagcaccgcggtggaaggaaaggcggaggatgacgaggagatcgacccgctcgacgccttcatggccgagatccaggaggagatccgcgcgcctcccccgccgcccaagcccgaggcgcttcgccgcgcggactccgacgatgacgaggatgaccccgtcgagagcttcctgcgggccaagaaggacgccgggctcacgctggccgccgacgccatgcgcgctggttacgactccgatgaggaggtctatgctgctgccaaggccgtcgacgccggcatgatggaatacgattccgatgacaaccccatagtcgtcgacaagaagaaaatagagcccataccagcactcgatcactcgaccattgagtatgacgctttcaccaaagatttctacgaggagaagccgtcgatttcaggtatgagtgaccaagaggtagcagattatatgaaaagtttggcaattcgggtttctggtttcgatgtgccaaggccaataaaaaacttccaggattgtgggtttcctgtaccgctaatgaatgctattgccaagcaagcttatgaaaaaccaactacaattcagtgccaggctttacctatcgtactttcaggcagagatatcattggtattgcaaaaactggttctggcaaaactgcagcttttgtgctccctatgattgttcatattatggatcagcctgagcttgagaaagaagaaggtcctataggagtaatttgtgctccaacaagagaattggcacatcagatatatctcgaagctaagaagtttgcaaagccttacaatcttcgagttgctgctgtatatggtggtgtttccaaatttgaccagtttaaagaactgaaagcaggttgtgaagtagtcattgcaactccagggagattaatagacttgctgaagatgaaggcattgaagatgttcagggcaacttatctggttcttgatgaagctgatcgcatgttcgatcttggatttgagccacaaatacgatctattgttggtcaaattagaccagatcgacaaaccttacttttttctgcaacaatgccatacaaagtagagcgtttggcaagagaaatattgactgatcctattagagttacagttggccaagttggcggtgctaatgaagacattaaacaagttgttaatgtactcccttctgatgttgagaaaatgccttggcttttggagaaattgcctggaatgattgatgatggagatgttcttgtattcgcatctaagaaggctagagtggatgagatagagaaagagttgaatcagagaggattcagaattgcagcacttcatggtgacaaggatcaagcttctcgtatggagactctgcagaagttcaaatctgggacgtatcatgttctggttgcaactgatgttgctgcacgaggtcttgacatcaaatcgattaaaacagttgtcaattttgatattgcaaaagagatggatatgcatattcaccgaattggaagaactggtcgcgctggtgataaagatggcactgcatacactctgattacacagaaggaagcacgctttgctggtgaactggttcacagtttgattgctgctggccaggatgtaccaaatgaactcatggatctggctatgaaggatggaagattcagagcaaaacgggactccaggaaaggtgggaagaaaggtggcaaaggaaaaggtggtggtggaggtgctgggcgcggtcgtggtgtgcgtggagttgattttggcctcggcataggttacaatgctgaatctggttcgcaagtgcctcctccaagatctgctgctgtaaattcgttgaagacagggatgatgcagcaatttaagagcagctttgtctctggatcttcaaatacaccaagcagcagtgcgccttcctttgtaagaccagcactccgtggctttgtgtctggcggcaccattggaggagatgcacggcctgcacagtcggcccccacttttgtccctgcatcccggccagcgcagcctgccccctctgtccctgcaccgcggcctgcaggaaacatcaatgaaaatgggaactcaaatccagaaagttcacgggatcggtccagggagagaaaacgaccatcaggttgggatcgctag

SEQ ID NO: 115 - protein, 766 aa, Sorghum bicolor
MSKRPKLEGFSIPRPTSYNFERSQPVQRLYRPTDDPDLDDIAFSDDAPSDAPASTAVEGKAEDDEEIDPLDAFMAEIQEEIRAPPPPPKPEALRRADSDDDEDDPVESFLRAKKDAGLTLAADAMRAGYDSDEEVYAAAKAVDAGMMEYDSDDNPIVVDKKKIEPIPALDHSTIEYDAFTKDFYEEKPSISGMSDQEVADYMKSLAIRVSGFDVPRPIKNFQDCGFPVPLMNAIAKQAYEKPTTIQCQALPIVLSGRDIIGIAKTGSGKTAAFVLPMIVHIMDQPELEKEEGPIGVICAPTRELAHQIYLEAKKFAKPYNLRVAAVYGGVSKFDQFKELKAGCEVVIATPGRLIDLLKMKALKMFRATYLVLDEADRMFDLGFEPQIRSIVGQIRPDRQTLLFSATMPYKVERLAREILTDPIRVTVGQVGGANEDIKQVVNVLPSDVEKMPWLLEKLPGMIDDGDVLVFASKKARVDEIEKELNQRGFRIAALHGDKDQASRMETLQKFKSGTYHVLVATDVAARGLDIKSIKTVVNFDIAKEMDMHIHRIGRTGRAGDKDGTAYTLITQKEARFAGELVHSLIAAGQDVPNELMDLAMKDGRFRAKRDSRKGGKKGGKGKGGGGGAGRGRGVRGVDFGLGIGYNAESGSQVPPPRSAAVNSLKTGMMQQFKSSFVSGSSNTPSSSAPSFVRPALRGFVSGGTIGGDARPAQSAPTFVPASRPAQPAPSVPAPRPAGNINENGNSNPESSRDRSRERKRPSGWDR

SEQ ID NO: 116 - DNA, 1707 bp, Arabidopsis thaliana
atggttgaatcggacaagtcatccgttgaagagctgaagaagagggttaggaagagaagccgtgggaagaagaatgagcagcaaaaggctgaagaaaaaacccacactgtagaggaaaacgctgatgaaacgcagaagaagagtgaaaagaaggttaagaaagtgagaggcaaaatcgaggaagaggaagaaaaggtggaagcaatggaagatggtgaagatgagaagaatattgtgattgtcgggaaagggataatgactaatgtgacttttgattccctcgacttatctgagcaaacttctatagctatcaaggagatgggctttcagtacatgacgcaaattcaagctggatcaattcagccccttttggaggggaaggatgttcttggtgctgccagaactggttctggtaaaactcttgcttttctcattccggctgttgagttgctgtttaaagagcgtttctctcctcgcaacgggactggtgtgattgttatttgccccacaagggaacttgctatccagactaaaaatgtggcggaggagttactcaagcatcattcacagacagtcagcatggttattggtggcaataacagaaggtcggaagcacaacgcattgccagtggttcaaacttggtgatagcaactcctggtcgtcttcttgaccatcttcagaatacaaaggctttcatttataaacacttgaagtgccttgtgatcgatgaagctgataggatactggaagagaattttgaggaagacatgaataagattctaaagattttaccaaagactaggcaaactgcgttattctctgccacccagacctctaaggttaaagatcttgctcgggtgtcattgacatcacctgttcatgtggatgtcgatgatggcagacgcaaggtgacaaatgaaggattggagcaaggctattgtgttgttccgagcaaacaaagacttatccttctaatttcctttttgaaaaagaacctaaataaaaagattatggtatttttctcgacttgcaagtcggtacaattccatacggaaatcatgaaaataagcgacgtggatgtctctgatattcatggaggcatggatcagaacagaagaactaaaacctttttcgacttcatgaaagcaaagaaaggtatcttgttatgtactgatgttgctgctcgtggtctcgatattccttccgtggactggattatacagtatgatccaccagacaagccaacggaatatatccatagggttggtcgaacagcccgtggagaaggagcaaagggaaaggcattacttgtcttgattcctgaagaacttcagtttattcgctacctgaaggctgcgaaagtacctgttaaagagcttgagttcaatgagaagaggcttagtaatgttcaatctgcgctggagaaatgtgttgccaaggactacaatctgaacaagttagccaaagatgcgtacagggcttatctctcagcatacaattcacactctttgaaagacatctttaatgttcaccgacttgacctcctggctgttgctgaatcgttctgcttctcttcgccgcctaaagtgaatctgaacatagaaagtggagctgggaaggtgaggaaggcgagaaagcagcaaggtcgcaatggcttcagtccttacagtccctatggcaagtccacacctacaaaggaggcataa

SEQ ID NO: 117 - protein, 568 aa, Arabidopsis thaliana
MVESDKSSVEELKKRVRKRSRGKKNEQQKAEEKTHTVEENADETQKKSEKKVKKVRGKIEEEEEKVEAMEDGEDEKNIVIVGKGIMTNVTFDSLDLSEQTSIAIKEMGFQYMTQIQAGSIQPLLEGKDVLGAARTGSGKTLAFLIPAVELLFKERFSPRNGTGVIVICPTRELAIQTKNVAEELLKHHSQTVSMVIGGNNRRSEAQRIASGSNLVIATPGRLLDHLQNTKAFIYKHLKCLVIDEADRILEENFEEDMNKILKILPKTRQTALFSATQTSKVKDLARVSLTSPVHVDVDDGRRKVTNEGLEQGYCVVPSKQRLILLISFLKKNLNKKIMVFFSTCKSVQFHTEIMKISDVDVSDIHGGMDQNRRTKTFFDFMKAKKGILLCTDVAARGLDIPSVDWIIQYDPPDKPTEYIHRVGRTARGEGAKGKALLVLIPEELQFIRYLKAAKVPVKELEFNEKRLSNVQSALEKCVAKDYNLNKLAKDAYRAYLSAYNSHSLKDIFNVHRLDLLAVAESFCFSSPPKVNLNIESGAGKVRKARKQQGRNGFSPYSPYGKSTPTKEA

SEQ ID NO: 118 - DNA, 1839 bp, Arabidopsis thaliana
atgagtgcatcatgggcagatgtggctgattcagagaaggccgtttctcagtcaaagcctccttatgttcccccacacctacggaacaggccatcagagcctgttgctgctcctttgccacaaaatgatcatgcagggtatggtggtcaaccagctgggtctcgttgggctcctcctagcagtgggggtggtggtgccagcggcggtggctataggaatgatggagggcgcactggctatggttatggtgctggaggaggaggtggtggtggtggtggctggaacaacagaagtggagggtgggaccgtagggaacgtgaagtaaacccatttggagatgatgctgagttagaaccggtctttacagagcaggagaatactggcattaattttgatgcctatgaagatattccagttgagaccagtgggggagacgtgccccctcctgttaacacatttgctgacatagatcttggggatgcattaaatctgaacatccggaggtgcaagtatgtgaggccaacaccggtacagcgtcatgctattccaatactgcttgcagagagagatttgatggcctgtgcccagactgggtctgggaagactgctgctttttgctttccaataattagtggaatcatgaaagatcagcatgtagaaagaccccgtggttcacgggcggtttacccttttgcagtcatcctctcaccaacaagggaattggcatgccagatacatgatgaagccaaaaaattctcctaccaaactggtgtgaaggttgttgttgcttatggaggaacacccattcaccagcagctcagggaactcgagaggggatgtgatatccttgtggcaactcctggccggttaaatgatttgcttgaaagagctagagtctcaatgcagatgattaggtttttagctctagatgaggcagacaggatgctggacatgggttttgagccacagattagaaagattgttgagcagatggacatgcctccacgtggggtgagacagacaatgctgttcagtgctacatttccaagtcagattcagagacttgcagctgatttcatgtcaaactatatatttttggctgtgggaagagttggttcaagcactgatttaattacccaaagggttgagtttgtccaagagtctgacaagagaagccatctcatggacctgcttcacgcgcaaagagagacccaagacaagcaatcattgacattagtttttgtggagacaaagaggggagctgatactttggaaaattggctgtgcatgaatgagtttccagcaacctccattcatggcgatagaacacaacaggaaagagaagtggcactgaggtccttcaaaactgggaggacacctattttggttgcaacagacgtggcagcacgtggtcttgacattccccacgtggctcatgttgtaaacttcgatctaccaaatgacattgatgactatgtccaccgtatcggacgaacaggacgtgcaggcaaatctggaatagcaactgccttcttcaacgagaacaatgcacaactggctaggtcgcttgctgagctaatgcaagaagccaatcaagaggtccccgagtggctcacacgatatgcttcacgtgcttcatttggtggtggtaagaaacggtctggtggtcggtttggtggccgtgacttcagaagggaaggctcttacagtagaggaggaggcggcggcggcggaggaggcggcagtgattactatggcggaggaggctatggtggtggtggatacggtggtgctccaagcggtgggtatggtgctggagtgaccagtgcttgggattag

SEQ ID NO: 119 - protein, 612 aa, Arabidopsis thaliana
MSASWADVADSEKAVSQSKPPYVPPHLRNRPSEPVAAPLPQNDHAGYGGQPAGSRWAPPSSGGGGASGGGYRNDGGRTGYGYGAGGGGGGGGGWNNRSGGWDRREREVNPFGDDAELEPVFTEQENTGINFDAYEDIPVETSGGDVPPPVNTFADIDLGDALNLNIRRCKYVRPTPVQRHAIPILLAERDLMACAQTGSGKTAAFCFPIISGIMKDQHVERPRGSRAVYPFAVILSPTRELACQIHDEAKKFSYQTGVKVVVAYGGTPIHQQLRELERGCDILVATPGRLNDLLERARVSMQMIRFLALDEADRMLDMGFEPQIRKIVEQMDMPPRGVRQTMLFSATFPSQIQRLAADFMSNYIFLAVGRVGSSTDLITQRVEFVQESDKRSHLMDLLHAQRETQDKQSLTLVFVETKRGADTLENWLCMNEFPATSIHGDRTQQEREVALRSFKTGRTPILVATDVAARGLDIPHVAHVVNFDLPNDIDDYVHRIGRTGRAGKSGIATAFFNENNAQLARSLAELMQEANQEVPEWLTRYASRASFGGGKKRSGGRFGGRDFRREGSYSRGGGGGGGGGGSDYYGGGGYGGGGYGGAPSGGYGAGVTSAWD

SEQ ID NO: 120 - DNA, 1902 bp, Arabidopsis thaliana
atggcgaatttggatatggagcaacattcatccgaaaacgaagagattaagaagaagaagcataagaaaagagcgagagacgaagctaagaaactaaagcagccagcaatggaagaagaacccgatcatgaagatggtgatgccaaagagaacaatgcgttaattgacgaagaaccgaagaagaagaagaagaagaaaaataagaagcgtggagatactgatgatggagaggacgaagcggtagcagaagaagagccgaagaagaagaagaagaaaaataaaaagctacagcagcgtggagatactaatgacgaagaggacgaagtgatagcagaagaagaagagccgaagaagaagaagaagaaacagaggaaggacacggaagcgaagtctgaagaagaagaagtagaagataaggaagaagaaaaaaaattggaagaaactagcataatgactaataaaacgtttgagtcattgtcattatctgataacacttataaatctatcaaggagatgggttttgcacgcatgactcagatacaagctaaagcaattccaccattgatgatgggagaagatgtacttggagctgccaggaccggttctggtaaaaccttagcttttcttattcctgctgttgagcttctttaccgtgttaagtttactcctcgcaatggaactggtgttcttgttatttgcccaacaagagagcttgctattcagtcttatggagtggcaaaagaacttcttaagtatcattcacagactgtgggaaaagttattggcggtgagaaaagaaagacagaagctgagattcttgcgaaaggtgttaatttattagtagctacccctggaagacttctcgaccaccttgaaaatactaatggttttattttcaagaacttaaagtttcttgtaatggatgaggctgataggatattggaacagaactttgaagaagacctcaagaagattttgaaccttctaccaaagactagacagacgtcactattttcagccacacagagcgcaaaggttgaggatcttgctcgggtgtcacttacctcacctgtttatattgatgtggatgaaggacgaaaagaggttacaaatgaaggcttggagcaaggttattgcgttgtgccaagtgcgatgcggttactttttttacttaccttcttgaagagattccaagggaaaaagaaaattatggtgtttttctctacatgcaagtcgacaaagttccacgccgagctctttcgatatatcaaattcgattgccttgaaatccgtggagggatagaccagaacaaaagaactccaacatttttgcaattcataaaggcggaaaccggtattttgttgtgtactaatgtcgctgcccgaggtcttgattttcctcatgtggactggattgtgcagtatgatcctcctgataacccaacggattatattcatcgagttggtagaacagctcgtggtgaaggagcaaaaggaaaggctctgcttgtcctaactccacaggagttgaagtttatacagtatctcaaggcggcgaaaattcctgttgaggaacatgaatttgaagaaaagaaattgctcgatgtgaaaccttttgtggagaatttgatatctgaaaactatgcattgaaggagtcagcaaaagaagcatacaagacatacatttcaggatatgattctcactctatgaaagatgtctttaatgttcaccaactcaatctcacggaggttgcgacttcgtttggtttctcagatcctcccaaagttgctctgaagatagatcgaggagggtacagaagtaagagagaaccggttaataagtttaagagaggtcgtggtggtggtagacccggcggtaaaagcaagttcgagaggtactaa

SEQ ID NO: 121 - protein, 633 aa, Arabidopsis thaliana
MANLDMEQHSSENEEIKKKKHKKRARDEAKKLKQPAMEEEPDHEDGDAKENNALIDEEPKKKKKKKNKKRGDTDDGEDEAVAEEEPKKKKKKNKKLQQRGDTNDEEDEVIAEEEEPKKKKKKQRKDTEAKSEEEEVEDKEEEKKLEETSIMTNKTFESLSLSDNTYKSIKEMGFARMTQIQAKAIPPLMMGEDVLGAARTGSGKTLAFLIPAVELLYRVKFTPRNGTGVLVICPTRELAIQSYGVAKELLKYHSQTVGKVIGGEKRKTEAEILAKGVNLLVATPGRLLDHLENTNGFIFKNLKFLVMDEADRILEQNFEEDLKKILNLLPKTRQTSLFSATQSAKVEDLARVSLTSPVYIDVDEGRKEVTNEGLEQGYCVVPSAMRLLFLLTFLKRFQGKKKIMVFFSTCKSTKFHAELFRYIKFDCLEIRGGIDQNKRTPTFLQFIKAETGILLCTNVAARGLDFPHVDWIVQYDPPDNPTDYIHRVGRTARGEGAKGKALLVLTPQELKFIQYLKAAKIPVEEHEFEEKKLLDVKPFVENLISENYALKESAKEAYKTYISGYDSHSMKDVFNVHQLNLTEVATSFGFSDPPKVALKIDRGGYRSKREPVNKFKRGRGGGRPGGKSKFERY

SEQ ID NO: 122 - DNA, 2202 bp, Arabidopsis thaliana
atgaagcgaacaatcaacgaagtcgtcggatctacctccgtcaatactctcgattcctccattgctaagaagcctgtcttcctcaccaaaaaacagcgggaagagttagccctaaaacgccgccaggatcaaatctccgagcaacgtgtccgtcgtgagcaacttggtcgccccgagcccgagacggaagatgtctccaatggagataccaatcgggataaggatcgagatagagatcgggaccgagaccgagaacgtgaccgagatagggagagagatagagggcgagatcgagaccgcgatagggatagagacagggatagggatagagagcgagagagagaccgtgagcgtgaccgtcgtgaacgagatcgtgaaccggatcggagaaatagagaaaaggagagggaagaggaggttaaggctagggagaaggcgcgtgttgagaaattagttgagagagagaaggagaaggaacttgacgccattaaagagcagtatcttggaggtaagaagccgaagaagagagtcattaggccaagcgagaagtttcgtttctcttttgattgggaaaacactgaggatacttctagggatatgaacgttctttaccaaaaccctcatgaagctcagcttctctttgggagagggtttcgtgctggtatggaccgtcgtgagcagaagaaacaagcggctaagcatgagaaagagatgcgagacgagattcgtaagaaagatggtattgtagagaaaccagaggaagctgctgctcagagagtgagagaagaagctgctgatacttatgactcgtttgatatgagggttgacaggcattggagtgataagagattagaggagatgactgaaagggattggcgtattttcagagaagatttcaatatctcttacaagggttcgaggattcctcgtccgatgaggagctgggaagagagtaagcttacttctgagcttttgaaagctgtggagagagctggatacaagaaaccttctcctattcaaatggcagctataccacttggactgcaacagcgtgatgttatcggcattgcagagactggttctggtaagactgctgcttttgttttacccatgttagcttacatctctagattgccaccgatgagcgaagagaatgagactgaggggccttatgctgttgttatggcccctactagagagcttgctcagcagattgaggaggaaactgttaagtttgcgcattatctagggtttagggtgacttctattgtgggtggtcagtcgattgaggaacaggggttgaagataacacaagggtgtgagattgtgattgctactccgggtcgtctgattgattgccttgagaggcgttatgcggtgttgaaccagtgtaactatgtggttcttgatgaggcagatcggatgattgacatgggtttcgagccacaggttgcaggtgtgttagatgcgatgccttcaagtaatttgaaacctgagaacgaagaagaagagcttgatgaaaagaagatttatagaactacatatatgtttagtgctacaatgcctcctggggtagagcggctagctcggaagtacttgaggaacccggttgttgtcaccattggtactgctggaaagactacggatttgatttcgcaacatgttattatgatgaaagaatcagagaaattcttcagattgcagaaactgctcgatgagctcggcgagaagactgccattgtgtttgttaacacaaagaaaaattgtgactcgattgctaagaatctggataaggcagggtaccgtgtcacgaccttgcacggtgggaaatcacaagagcagagagaaatcagcttagaaggattcagagcaaagagatacaacgttcttgttgcaacagatgttgtaggacgtggaattgatattccggatgtggctcatgtcataaactacgacatgcctaaacatatagagatgtacacacatcgtatcggacgtacaggacgtgctgggaaaagtggtgttgcgacttcgttcttgacacttcatgataccgaagtcttctatgatctgaagcagatgcttgttcagagcaacagtgcggtgcctcctgagctggcgagacatgaagcgtccagattcaaaccaggtacggttcctgatagacccccaagacatagtgacactgtctatataaattga

SEQ ID NO: 123 - protein, 733 aa, Arabidopsis thaliana
MKRTINEVVGSTSVNTLDSSIAKKPVFLTKKQREELALKRRQDQISEQRVRREQLGRPEPETEDVSNGDTNRDKDRDRDRDRDRERDRDRERDRGRDRDRDRDRDRDRDRERERDRERDRRERDREPDRRNREKEREEEVKAREKARVEKLVEREKEKELDAIKEQYLGGKKPKKRVIRPSEKFRFSFDWENTEDTSRDMNVLYQNPHEAQLLFGRGFRAGMDRREQKKQAAKHEKEMRDEIRKKDGIVEKPEEAAAQRVREEAADTYDSFDMRVDRHWSDKRLEEMTERDWRIFREDFNISYKGSRIPRPMRSWEESKLTSELLKAVERAGYKKPSPIQMAAIPLGLQQRDVIGIAETGSGKTAAFVLPMLAYISRLPPMSEENETEGPYAVVMAPTRELAQQIEEETVKFAHYLGFRVTSIVGGQSIEEQGLKITQGCEIVIATPGRLIDCLERRYAVLNQCNYVVLDEADRMIDMGFEPQVAGVLDAMPSSNLKPENEEEELDEKKIYRTTYMFSATMPPGVERLARKYLRNPVVVTIGTAGKTTDLISQHVIMMKESEKFFRLQKLLDELGEKTAIVFVNTKKNCDSIAKNLDKAGYRVTTLHGGKSQEQREISLEGFRAKRYNVLVATDVVGRGIDIPDVAHVINYDMPKHIEMYTHRIGRTGRAGKSGVATSFLTLHDTEVFYDLKQMLVQSNSAVPPELARHEASRFKPGTVPDRPPRHSDTVYIN

SEQ ID NO: 124 - DNA, 1716 bp, Chlamydia reinhardtii
atgatcaagcagcaatacctgggcatggaaaagctgaagaagcgggtgctgcgccccagcgagaagttcaagttcaattttgactgggactccaaggacgacacttcgcgggacctcaacccgctctacaacaacctgcacgaggcggcactgatgtttggtcgcggcatgcgcgccggcattgaccgccgcgagcagaagaaggtcgcggcggcgctggagacagaaatcctgcgcaagacgcgcatggcggcgggtatcgaggacacgcacgagacgcgcgagcacgaccgcgagcgcaagcgcctggcggaccagtacgacggattcgacatgcgggttgagaagcactggaccgagaagtcgctggacgagatgaacgagcgcgactggcgcatcttcagggaggacttcaacatcgggtaccgcggcgtcaacacggtgcttcccatccgcaagtgggaggagagcgggctgccctcgctgttgctcaaggccattgagaaggtgggctacaagaagccgtctcccatccagatggcggccatcccgctgggcctcaagcagcgcgacgtcattggtattgccgagaccggctcaggcaagaccgctgcattcgtgctgcccatgcttgcctacatcatgcggcagccgcccatgaacgaggagaacgaggcggacggaccctacgccgtggtgctggcgcccacgcgtgagctggcgcagcagattgaggaggagacgcacaagctggcgcactacaccggctaccgcgtcacctcagtggtgggaggccagtccatcgaggagcagggcaccaagctgcgcaagggctgcgagattgtgatcgccacgcccggccgcctgcttgactgcatcgaccgccactatgcggtgctcaaccagtgcaactatgtggtgctagatgaggcggaccgcatgatcgacctgggcttcgagccgcaggtgattggcgtgctggacgcgatgcccaagagcacgcttaagccagacgaggagggcgcggtgctggaggagaaccgcacctaccgcaccacatacatgttcagcgcgaccatgccacccgcggtggagcggctggcgaagaagtacctgcgccggccagtggtggtggtgatcggcagcgcgggcagggtcacggacaacgtcacgcagcgcgtgttcgtggtcaaggagaacgagaagggacgactgctggagcaggagctcaacaacgtggacgagaagcgtgtcattgtgttcgtcaacacacaacgccagtgcgacaatgtgcacagacatatggacgagctgggataccactgcaccatcctgcacggaggcaagacgcaggaccagcgcgaggccggcatcaagggattcagggacggaacttacaacgtgctcattgccaccgacgtggcgggccgcggtatcgacgtccccgacgtggcgctcgtggtcaactacgatatgcccaccaacatcgagaactacacccaccgcatcggtcgtaccggccgcgccggacgcaagggtatcgccgtaaccttcctcacgctcggcgacacgggcgtgttcttcgacctcaagaagctgctggaggactccaaggccgccgtgcctccggagctggcgcgccacgaggcgtccaaggtcaagcctggcactgtggaggctaagagccgcaaggaccagaccgtgttcgctacgtag

SEQ ID NO: 125 - protein, 571 aa, Chlamydia reinhardtii
MIKQQYLGMEKLKKRVLRPSEKFKFNFDWDSKDDTSRDLNPLYNNLHEAALMFGRGMRAGIDRREQKKVAAALETEILRKTRMAAGIEDTHETREHDRERKRLADQYDGFDMRVEKHWTEKSLDEMNERDWRIFREDFNIGYRGVNTVLPIRKWEESGLPSLLLKAIEKVGYKKPSPIQMAAIPLGLKQRDVIGIAETGSGKTAAFVLPMLAYIMRQPPMNEENEADGPYAVVLAPTRELAQQIEEETHKLAHYTGYRVTSVVGGQSIEEQGTKLRKGCEIVIATPGRLLDCIDRHYAVLNQCNYVVLDEADRMIDLGFEPQVIGVLDAMPKSTLKPDEEGAVLEENRTYRTTYMFSATMPPAVERLAKKYLRRPVVVVIGSAGRVTDNVTQRVFVVKENEKGRLLEQELNNVDEKRVIVFVNTQRQCDNVHRHMDELGYHCTILHGGKTQDQREAGIKGFRDGTYNVLIATDVAGRGIDVPDVALVVNYDMPTNIENYTHRIGRTGRAGRKGIAVTFLTLGDTGVFFDLKKLLEDSKAAVPPELARHEASKVKPGTVEAKSRKDQTVFAT

SEQ ID NO: 126 - DNA, 1839 bp, Chlorella vulgaris
atggcatatcatgagaacggaggtcctgctggtgggatgaggagtggttatgttcctccccatatgcgcagtggtggagtcccgcagcctttcgatgatcgtcgaggcggtgcccctatgggtggaggcgcattcagaggtggtggtggcgggggttacagcagaggtgcctatggtggttccaggcctggtggtggctatggcgcgccgcgcggtggtggtggttccggctggggcggtggaaattcagacgatcgggacccatttgctgaagacaaggcacgcaagcaggaagtggatgcaatgttcacgcaagagaacacggggatcaacttcgacgcctacgacgacattccggtcgaggccacgggggagcaggtgcccaacccaatcaccagcttcgacgatgccgacctgccccctgcactggcagccaacacagtgcgctgcaactacaccaagcccacaccagtgcagaagtactccatccccatcggcctggcgcatcgcgacctgatggcttgcgcgcagacgggctccggcaagacggccgccttctgcttccctatcatcgccaacatcctcaagtccaacgtgcagccgctggggcgcagcaggaaggcgcaccccatggcactggtgctcagccccacgcgcgagttgtcctcccagatctacgacgaggcccgcaagttcacctaccagacaggcatccgccctgtcgtcgtgtacggaggcgcacccgtcatgaaccagctgcgggagatggagcgcggctgcgacatcctggtggcgacgcccgggcggctgagcgacctgatcgagcgcgcgcgtgtgtcgctctcgcgcgtcacctacctggcgctggacgaggccgaccgcatgctggacatgggtttcgagccgcagatccggcgcatcgtggagcaggaggacatgccgcgcaccgggcagcgccagacgctgctgttcagcgccaccttccccaaggagatccagcgcctggccgctgacttcctgcacaactacatcttcctggccgtgggccgcgtgggctcctccaccgagctcatcgtgcagcacatcgagtatgtgtcccccggtgacaagcgccaggtcctcctcgacctcatcaacaccgtcgagggcctgacgctggtctttgtggagaccaagcgcggagcggatgccctggaggacttcctggccggcaacaacttccctgccacatctatccacggcgaccgctcccagcaggagcgcgaggcggccctgcgcagcttcaggtcgggccgcacgccaatcctggtggcgactgacgtggccgctcgtgggctggatatcccccatgtgacccacgtcatcaacttcgacctgcccaccgatgtggacgattacgtgcaccgcatcggtcgcacagggcgtgccggcaagaagggcctcgccactgccttctttactgacaaggacgctggcctggccaagggcctcgcagagctgctgcaggagacaaaccaggaggtgccaggctggctgcaaaacatttcggcgcgctcggccccttacggccagaagagttcgcgtggtggcggccgcagcggcaacaaccgctttggaggccgcgactaccgccaggaccgcggagccagctacgggggtggcggcggcagctacgggggcggcggcagctacggtggcggcggcggctacggcgtcgcaccagctgcatatggcgctgcttatggcggcgctggctacagccatgctcccagctacggtgcggctggcgcgtacggcgtccagagcggcggcgccggctaccaaagcgcatgggactaa

SEQ ID NO: 127 - protein, 612 aa, Chlorella vulgaris
MAYHENGGPAGGMRSGYVPPHMRSGGVPQPFDDRRGGAPMGGGAFRGGGGGGYSRGAYGGSRPGGGYGAPRGGGGSGWGGGNSDDRDPFAEDKARKQEVDAMFTQENTGINFDAYDDIPVEATGEQVPNPITSFDDADLPPALAANTVRCNYTKPTPVQKYSIPIGLAHRDLMACAQTGSGKTAAFCFPIIANILKSNVQPLGRSRKAHPMALVLSPTRELSSQIYDEARKFTYQTGIRPVVVYGGAPVMNQLREMERGCDILVATPGRLSDLIERARVSLSRVTYLALDEADRMLDMGFEPQIRRIVEQEDMPRTGQRQTLLFSATFPKEIQRLAADFLHNYIFLAVGRVGSSTELIVQHIEYVSPGDKRQVLLDLINTVEGLTLVFVETKRGADALEDFLAGNNFPATSIHGDRSQQEREAALRSFRSGRTPILVATDVAARGLDIPHVTHVINFDLPTDVDDYVHRIGRTGRAGKKGLATAFFTDKDAGLAKGLAELLQETNQEVPGWLQNISARSAPYGQKSSRGGGRSGNNRFGGRDYRQDRGASYGGGGGSYGGGGSYGGGGGYGVAPAAYGAAYGGAGYSHAPSYGAAGAYGVQSGGAGYQSAWD

SEQ ID NO: 128 - DNA, 1836 bp, Glycine max
atgagaacttcgtgggcggattctgctgacaactctgccattggttctggcatcaccaatgcctcggcttgcccttcccggggagcttatgtaccgccacatcttcggaaccgggcattgtcgtcagaggttcctctggcggcagcgtcacacccggcggtggctctggggaatgaccgggttaatcatagtggtccagctcctcatcagggtggtggttactttaaacctgatcacgggcggcagcagcagcaaggatatggttctggttttcagagtggtggtggcggtggctggaatggtagaggggtggggagggaccgtgggaggcgtgaggcgaacccttttgagaatgttgaagctgaggatcaatcttttagtgagcaagagaatacggggattaactttgaggcatatgatgatatccctgtggagactagcggggagaatgtgccactgcccgtgaattcattcgcggaaatagatttgggtgtggcattgaatcagaatatacagagatgcaagtatgtgaaaccaaccccggttcagaggtatgccattccgatttctcttgcggggcgagacttgatggcctgtgctcagactgggtcaggaaagacagctgccttttgcttccctattataagtggaatcatgagggagcaatatgctcaaaggccgcgtgtggctcgaactgcttatccgctggcacttatcctctcccctacaagggagctttcatgtcagatacatgatgaggccaaaaagttttcttatcaaactggtgtcaaagtggtggttgcttatggaggagcaccaatcacccaacagttacgggagcttgagagaggcgttgatattctggtggcaactccaggacgattggtggatttgcttgagagggctaggttgtcattgcagatgataagatacttggctcttgatgaggcagatcggatgctggatatgggttttgagcctcaaataagaaagatagttgaacaaatggacatgcctcctccaggcatgagacagacgctgttgtttagtgccacatttcccaaagagatacaggctcttgcatcagattttctttcacgttatgtgtttctggctgttggaagggtcggttcaagtactgatctaattgctcaaagagtagaatatgtgctcgagtcagacaagagaagccacctcatggaccttcttcatgctcagagggaaactggagttaatggcaagcaaggtctgacattagtttttgtggaaacgaagaaaggagctgatgcattggaacactgcttgtgtgttaatggatttcctgcagctagcattcatggtgacagaacacaacaagaaagagaactagcattgaggtcattcaagactggaaacacaccaattctagtggcaacagatgttgctgcacgtggtcttgacatcccacgggtagcacatgtggtaaattttgatcttcccaatgacattgatgattatgtgcaccggataggaagaacggggcgagctggtaaaatgggattagcaacggccttcttcaacgaaggtaatttcaacatggctaaaccattagctgatctgatgcaagaagcaaatcaagaagtacctgcctggctcagccgttatgcggcaagggctacttacagtggtggcaacagaaataggaagtcggggggatcccgttttggtggccgagattttaggaaagagggctcgtttaataaagcaacagattactatggtggcggaactggtggtggatattgtggcaattatggtggagggtatggtcaaggtgtgcctagtgcttgggattag

SEQ ID NO: 129 - protein, 611 aa, Glycine max
MRTSWADSADNSAIGSGITNASACPSRGAYVPPHLRNRALSSEVPLAAASHPAVALGNDRVNHSGPAPHQGGGYFKPDHGRQQQQGYGSGFQSGGGGGWNGRGVGRDRGRREANPFENVEAEDQSFSEQENTGINFEAYDDIPVETSGENVPLPVNSFAEIDLGVALNQNIQRCKYVKPTPVQRYAIPISLAGRDLMACAQTGSGKTAAFCFPIISGIMREQYAQRPRVARTAYPLALILSPTRELSCQIHDEAKKFSYQTGVKVVVAYGGAPITQQLRELERGVDILVATPGRLVDLLERARLSLQMIRYLALDEADRMLDMGFEPQIRKIVEQMDMPPPGMRQTLLFSATFPKEIQALASDFLSRYVFLAVGRVGSSTDLIAQRVEYVLESDKRSHLMDLLHAQRETGVNGKQGLTLVFVETKKGADALEHCLCVNGFPAASIHGDRTQQERELALRSFKTGNTPILVATDVAARGLDIPRVAHVVNFDLPNDIDDYVHRIGRTGRAGKMGLATAFFNEGNFNMAKPLADLMQEANQEVPAWLSRYAARATYSGGNRNRKSGGSRFGGRDFRKEGSFNKATDYYGGGTGGGYCGNYGGGYGQGVPSAWD

SEQ ID NO: 130 - DNA, 1833 bp, Glycine max
atgctgtggtcttatgcctcgcactatgtccctccacaacaccgcactaacagcttccaaaccttaaccgatgattcaaccagccgtggtggcgctagaccacgtgacggtggccgcggtggttccggcagccgtgggttttctcgtccccgcattccttctaaccggttacccgtggaggaaccacaagacggcagcgacgctattaacttcgacgcgtacgagtcggtaccggtggaggcgagtgggaaggacgtgccaccgccggtgaacaccttcaatgaagcggacttggacgaaggtttaaagaggaacatcgaccgatgcaagtatgtgaaacccacgccggttcagcgccacgcgattcccatcgcgagtgcgggacgcgacctaatggcgtgcgcacagaccggttcgggcaaaacggcagcgttttgttttcccattatatctgggattttgaagggtcgttctctttctgggttttcatcaatgccggctcgtggtgccgctgttgcataccccactgcacttattctgtctcctaccagggagttatcatgccagatacgcgatgaagcgaataaatatgcgcatcaaactggagtgaaggttgttgttgcctacggtggggctcctattactcagcagctgcgccttatggagaaaggtgttgatatattggttgcaactcctgggcgtttggtggatattattgaaagagaaagggtttcgttgacaaagataaagtatcttgctttggatgaggctgatcgtatgttggacatgggttttgaacaccaaatacgcaagattgtggagcaaatgcagatgccctcgccaggtattaggcaaacattgttgtttagtgccacgtttcctaatgatatacagaagctagcatcggactttttatccaactacatattcctgtctgttggaagggttggatcgagtactgaactgattgtgcagaagattgagcttgtacaggatatggacaaaagggaccatcttattaatcatctgcgacgtcaaaaggtgcatggggcaaatgggaagcatgctttgactcttgtatttgttgaaaccaaaagaggagcggatgttttagaaggttggttgttgagaagtggcttttcagctgttgccatacatggtgacaaagttcaaatggaaagggaacgggctttaagatcattcaaatctggtttgactcccattttggttgcaactgatgttgcttcacggggattggatatcccgcatgtggctcatgttataaactttgacttgcctagagacattgataactacgtacatagaattggaagaacaggccgtgcaggcaaatctgggttagccactgccttcttcagcgacaagaatagccctattgcaaaggctcttattggactcttgcaggaagcaaaccaagaagttccatcttggctcaaccaatatgctactgagggttcatcatctggtgggggtggtcgtggctatgaagctcagcgttaccgcagtggcagttatggtggtcatgatttccggaatgtcactgaacctgaggtgcagaattacaactgctacaataccaatggcaatgcagttcagtttgtagagtcttacactgctgatgatgcctcttacgttgatacctcctatgacatccaaaactccaatatagattgctcttttgaatgtttacatatagcttcttccggcagttataatcacactgattcttgtgagttgaatggaggtggtggtagggttgaagaagatgggccacgcggttatgcatctattgttgccactggatgggattag

SEQ ID NO: 131 - protein, 610 aa, Glycine max
MLWSYASHYVPPQHRTNSFQTLTDDSTSRGGARPRDGGRGGSGSRGFSRPRIPSNRLPVEEPQDGSDAINFDAYESVPVEASGKDVPPPVNTFNEADLDEGLKRNIDRCKYVKPTPVQRHAIPIASAGRDLMACAQTGSGKTAAFCFPIISGILKGRSLSGFSSMPARGAAVAYPTALILSPTRELSCQIRDEANKYAHQTGVKVVVAYGGAPITQQLRLMEKGVDILVATPGRLVDIIERERVSLTKIKYLALDEADRMLDMGFEHQIRKIVEQMQMPSPGIRQTLLFSATFPNDIQKLASDFLSNYIFLSVGRVGSSTELIVQKIELVQDMDKRDHLINHLRRQKVHGANGKHALTLVFVETKRGADVLEGWLLRSGFSAVAIHGDKVQMERERALRSFKSGLTPILVATDVASRGLDIPHVAHVINFDLPRDIDNYVHRIGRTGRAGKSGLATAFFSDKNSPIAKALIGLLQEANQEVPSWLNQYATEGSSSGGGGRGYEAQRYRSGSYGGHDFRNVTEPEVQNYNCYNTNGNAVQFVESYTADDASYVDTSYDIQNSNIDCSFECLHIASSGSYNHTDSCELNGGGGRVEEDGPRGYASIVATGWD

SEQ ID NO: 132 - DNA, 1776 bp, Glycine max
atgcgaacttcatgggctgatttggctgccaattcggcgtctgaaaatgcgggaacctctaactccacagctccttcgcggccggtttatgtgcctccgcatctgaggaaccgtggaccatcagaatcccttgctccagcacctccatccaataataataataatgtgggatcacggtggggtgctctgccacccagaaacggatgggggaacagaagtggtggttgggatcggcgcgaagtgaatcccttcggaggtcaggaggatgcagcagcagaagaggagttgggaggcgaggagcagcaggagagcacgggaattaactttgatgcgtatgaggacattccggtggagacgagcggtgaaaacgtgcccccggctgtgaatacttttgcggagattgacttaggcaacgcgcttaatcagaacattagacgctgcaaatatgtgaagccaacgccggttcagcggcatgccataccgatatcccttgcggggcgggatttgatggcttgtgcgcagactggttctggaaagactgccgcattctgtttcccaatcatcagtgggattatgagaggccaagcccaagtcctccagaggccgcctcctcgcggtgtccgcacagtctacccacttgcccttgttctctcacctactagggagctatccatgcagatacatgaagaggctaggaaattttcttaccagactggggttagggtcgttgttgcttatggtggagctccgataaaccaacagctccgggaacttgagagaggggtggatatccttgttgcaactccgggaagactggtagatttactggagagagctagagtttcattgcaaatgattaggtatttggccttagacgaggcagatagaatgctggatatgggttttgagccacaaataaggaagattgtagaacaaatggacatgcctccagcagctgccagacagactatgctgttcagtgccacatttccaaaagagatacagagacttgcctccgatttcctttcaaattatatttttctggctgttggaagagtgggctcaagtactgatttaattgtccaaagagttgagtatgttcaagagtctgacaagagaagtcacctcatggatcttcttcatgcacagaaggcaaatggtgtacaaggaaagcaagctttgactttagtttttgtggagacaaagaagggagctgatgctctagagcactggttgtgccgtaataattttccagcaactactattcatggtgacaggacacaacaggaaagagaattggcattaaggtcatttaaaagtggcaacacccccatattggttgcaactgatgtggctgcacgtggtcttgatattcctcatgttgcccatgtggttaactttgaccttcctaatgatattgatgattatgtacaccgaattggaaggacagggcgggcaggaaagaaaggccttgcaactgcgttctttaatgacaacaatgcatccctggcaagggccttagcagatctgatgcaagaagcaaatcaagaagtacctgattggctctcacggtttgctgctcgctcttcctttggtgggggaaggaaccgtcgatcaggaggaggccgttttggtggccgtgactttcgaagagagggttcttttagtaggggtggttctgattactacagtgcaggaaacaacagtagtggatatggcacttctggtgggtatggtggaggatatggtcctggggtaaccagtgcatgggattga

SEQ ID NO: 133 - protein, 591 aa, Glycine max
MRTSWADLAANSASENAGTSNSTAPSRPVYVPPHLRNRGPSESLAPAPPSNNNNNVGSRWGALPPRNGWGNRSGGWDRREVNPFGGQEDAAAEEELGGEEQQESTGINFDAYEDIPVETSGENVPPAVNTFAEIDLGNALNQNIRRCKYVKPTPVQRHAIPISLAGRDLMACAQTGSGKTAAFCFPIISGIMRGQAQVLQRPPPRGVRTVYPLALVLSPTRELSMQIHEEARKFSYQTGVRVVVAYGGAPINQQLRELERGVDILVATPGRLVDLLERARVSLQMIRYLALDEADRMLDMGFEPQIRKIVEQMDMPPAAARQTMLFSATFPKEIQRLASDFLSNYIFLAVGRVGSSTDLIVQRVEYVQESDKRSHLMDLLHAQKANGVQGKQALTLVFVETKKGADALEHWLCRNNFPATTIHGDRTQQERELALRSFKSGNTPILVATDVAARGLDIPHVAHVVNFDLPNDIDDYVHRIGRTGRAGKKGLATAFFNDNNASLARALADLMQEANQEVPDWLSRFAARSSFGGGRNRRSGGGRFGGRDFRREGSFSRGGSDYYSAGNNSSGYGTSGGYGGGYGPGVTSAWD

SEQ ID NO: 134 - DNA, 1443 bp, Ostreococcus lucimarinus
atggaagaggaagaagcggcggcggcgagaaacgatcctgactccgaggcgacgaagatgtttaccggcgaaaacaccggtttggactttgacctgtacgacgacattcccgtggagacgagcggacgcgacgtgccggagcccatcacttcgttcgtcgacctcgacctcggggcggccgtgaacacgaacatcaagagatgcaagtttaagaatccgacgccggtgcaaaagtacgccattccagcttcgctggcgggaagagatttaatggcgtgcgcgcagacgggttccggtaaaacggcggcgttttgctttcccatcatcgccggtatcttgaagcgcggtcttcaaggcggtcatatgaaccgcaagacgtatcctctcgcgctcgtgctttcgccgacgcgcgaattggcgagccagattcacgaagaatcgcggaagttcgcgtaccaaaccggcgtcgcctcgtgcgtcatctacggtggcgctccggcggtggaacaattccgcgccatggaacgcgggtgcgacattctcgtcgccacgccgggtcgtttgatcgatctcatcgatcgcgctaagatctcgttgagcagagttcaatatctcgcgctcgacgaggcggatcgcatgttggatatgggtttcgagccgcaaattcgacaaatcgtcgacgagcgcgacatgccgcgatgtggcgagcgtcaaacgatgttgttctccgcaacgttcccgagggaaatccagcgaatggcttcggacttcttggacgattacgtctttctcacggtcggtcgcgtcggctcttcgcacgcgttgatcacgcaatccgtcgagcgcgtgacttcgtaccacgaaaagagcaatatgcttctcgatttggtcgaagccgtgccgggtttgactttggttttcgtcgaaacgaagcgaggtgcggaccagctcgaggatttcttgtaccaaaacggtaagcccgcgacgagcatccacggcgatcgcacgcagcaggagcgcgaggcggcgttgaaatccttccgagcgggtaagacgcccatcctcgtcgccacggacgtcgcggcgagaggtttggatattcctcacgtcacccacgtcatcaactttgacttgccatcggatatcgacgactacacgcaccgcatcggtcgtaccgggcgcgcggggaagaagggtcgggcgacggcgctgtttttagaatccaaagacggccaaatggctcgcccgttgacggagctcatgagcgaggcgaaccaggaagtgccgacgtggttgacgcaaatctctggccattccttcggcggtggtggacgtcgtcgcggtggtggtggcgggaatagattcggcggtcgcgactaccgcggcggcggcggcggcggcggcggcggcggcggcggcggcggcggctggggccgcgagtaa

SEQ ID NO: 135 - protein, 480 aa, Ostreococcus lucimarinus
MEEEEAAAARNDPDSEATKMFTGENTGLDFDLYDDIPVETSGRDVPEPITSFVDLDLGAAVNTNIKRCKFKNPTPVQKYAIPASLAGRDLMACAQTGSGKTAAFCFPIIAGILKRGLQGGHMNRKTYPLALVLSPTRELASQIHEESRKFAYQTGVASCVIYGGAPAVEQFRAMERGCDILVATPGRLIDLIDRAKISLSRVQYLALDEADRMLDMGFEPQIRQIVDERDMPRCGERQTMLFSATFPREIQRMASDFLDDYVFLTVGRVGSSHALITQSVERVTSYHEKSNMLLDLVEAVPGLTLVFVETKRGADQLEDFLYQNGKPATSIHGDRTQQEREAALKSFRAGKTPILVATDVAARGLDIPHVTHVINFDLPSDIDDYTHRIGRTGRAGKKGRATALFLESKDGQMARPLTELMSEANQEVPTWLTQISGHSFGGGGRRRGGGGGNRFGGRDYRGGGGGGGGGGGGGGGWGRE

SEQ ID NO: 136 - DNA, 1245 bp, Oryza sativa
atggcgggaatggcaccagagggatcccagtttgatgctaagcactatgattctaaaatgcaggagcttctgaaccaaggtgaaaccgaggagttcttcacatcttatgatgaagttcatgagagttttgatgacatgggtctccaagagaaccttctcagaggcatctatgcctatggtttcgagaagccttcagccattcagcaaaggggtattgtccctttctgcaagggtcttgatgtgattcagcaagctcagtcaggaacaggaaagactgccaccttctgttctggaattttgcagcaacttgactatgctgtggttgagtgccaggccttggtccttgctcctactcgtgagcttgcacagcaaattgagaaagtcatgcgcgcacttggtgactatctgggtgtgaaggttcatgcttgtgttggaggtacttctgttcgtgaggaccaaaggattcttgcaagtggagtgcatgttgttgttggaacacctggtcgtgtgtttgacatgctgcgtaggcagtccctccgtcctgattacatcaagatgtttgtccttgatgaagctgatgaaatgctttctcgtggtttcaaggatcagatttatgatatcttccagctcctcccgtcaaagatccaagttggtgtgttctctgctacaatgccccctgaggcccttgagatcacccgtaaattcatgaacaagcctgtgcggatccttgtgaagagggatgagctcactcttgagggtatcaaacagttttatgtcaatgtggagaaggaagaatggaagcttgacacactctgtgacctgtatgagacactggccatcacgcagagtgtcatctttgtgaacacccgccgcaaggtggactggctcactgataagatgaggggcagggatcacacagtttctgctacccatggtgacatggaccagaacactagggacatcatcatgagggagttccgatctggttcttcccgtgtgctcattaccacggaccttcttgcccgtggtattgatgtccagcaggtgtcccttgtcatcaactatgatctgccgacccaacctgagaactacctgcatcgcattggtcgtagtggtcgttttggtaggaaaggtgttgccattaactttgtgacccgtgacgatgagaggatgctgtttgacatccagaggttctacaatgtggtgattgaggagctgccggccaacgtcgctgaccttctgtga

SEQ ID NO: 137 - protein, 414 aa, Oryza sativa
MAGMAPEGSQFDAKHYDSKMQELLNQGETEEFFTSYDEVHESFDDMGLQENLLRGIYAYGFEKPSAIQQRGIVPFCKGLDVIQQAQSGTGKTATFCSGILQQLDYAVVECQALVLAPTRELAQQIEKVMRALGDYLGVKVHACVGGTSVREDQRILASGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 138 - DNA, 1872 bp, Oryza sativa
atggcgaccccctcccgcacctcctgggccgacgtcgccgacgccgaccccgccccggcccccgcccccgccgccaacggccccgcccgccccgaccggagctcctacgtgcccccccacctccgcaaccgcggggcttcgtcgggtgggggcgcggcggcgcctccgccctcatcatcctcctcctccgcgccgccccctcgcgccgcccctggcctcctcgccccccgccccgccgccgccggcatggggaggatgggcggcggcggtggcggcggaggattcggtgggccaaggaggtgggaccgggagccgaacccgttcgggaacgacggcgacgccgcggcgggggcgggggacgagccggaggtgttcgacgcgcaccagaacaccgggatcaacttcgacgcgtacgaggacatccccgtggagacgagcgggagggaggtgccgccgccggtgggcacgttcgccgagatcgacctgggccaggcgctcaacgacaacatccgccggtgcaagtacgtgcgccccacgcccgtgcagcggtacgccatcccgatctcgctcgcggggagggacctcatggcgtgcgcgcagaccgggtccgggaagacggccgccttctgcttccccatcatcagcggcatcatgcgcggcccgcccgcgcaaaggccccagcgcggcgggatgaggaccgcctgccccctcgcgctcatcctctcccccaccagggagctctccatgcagattcatgaggaggcgagaaaattttcctatcagaccggtgtcagggtggttgttgcatatggaggagcacctattaatcagcagttgagagatcttgagaggggtgttgacattcttgtggctactcctggccgtttggttgatttattggagagggcaagagtatctttgcaatctatcagatatcttgcccttgatgaggcagatagaatgcttgatatgggttttgaaccgcaagttaggagaattgttgagcaaatggacatgcctccgccaggtgccaggcagacaatgttgttcagcgccacgttcccaaaagaaatccagagaatggcatctgacttcctggagaactacatattcctggctgttggaagagttgggtcaagtacagatttgattgtacagagagttgagtttgtgcaggaggcagacaaaagaagccacttgatggatctgcttcatgcacaaagagacagtgctactccaggaaagccaactcttacacttgtctttgtggaaaccaaaaggggtgctgattcgttggagcactggttgtgtatgaatggatttccagctacttctattcacggtgatagaaaccagcaggaaagagagtatgctttgagatccttcaaaagtggacatactcctattctagttgcaactgatgtggcagcccggggccttgacattcctcatgttgctcatgttgtgaactttgatcttcccaatgatatagatgattacgtccacaggattgggaggacagggagggcaggaaaaagtggtcttgcaactgctttcttcaatgagaataactcttccatggcaaggtctttggctgagctaatgcaagaatctaatcaagaggtacctgcgtggttgtctcgctatgctgctcgcccatcttatggtgggggtggtgggaggaacagaaggtccggtggtgggagccgcttcggtggccgtgacttccgcagggattcttcctctggaagaggtggcggtgactactatggtggaggcagcagcggtggagctggtggatatggtggttcctctgcatatgggggtggcggctatggtggcggcgcgggtgctccaagtgcctgggattaa

SEQ ID NO: 139 - protein, 623 aa, Oryza sativa
MATPSRTSWADVADADPAPAPAPAANGPARPDRSSYVPPHLRNRGASSGGGAAAPPPSSSSSSAPPPRAAPGLLAPRPAAAGMGRMGGGGGGGGFGGPRRWDREPNPFGNDGDAAAGAGDEPEVFDAHQNTGINFDAYEDIPVETSGREVPPPVGTFAEIDLGQALNDNIRRCKYVRPTPVQRYAIPISLAGRDLMACAQTGSGKTAAFCFPIISGIMRGPPAQRPQRGGMRTACPLALILSPTRELSMQIHEEARKFSYQTGVRVVVAYGGAPINQQLRDLERGVDILVATPGRLVDLLERARVSLQSIRYLALDEADRMLDMGFEPQVRRIVEQMDMPPPGARQTMLFSATFPKEIQRMASDFLENYIFLAVGRVGSSTDLIVQRVEFVQEADKRSHLMDLLHAQRDSATPGKPTLTLVFVETKRGADSLEHWLCMNGFPATSIHGDRNQQEREYALRSFKSGHTPILVATDVAARGLDIPHVAHVVNFDLPNDIDDYVHRIGRTGRAGKSGLATAFFNENNSSMARSLAELMQESNQEVPAWLSRYAARPSYGGGGGRNRRSGGGSRFGGRDFRRDSSSGRGGGDYYGGGSSGGAGGYGGSSAYGGGGYGGGAGAPSAWD

SEQ ID NO: 140 - DNA, 1803 bp, Physcomitrella patens
atgccatcaacatgggcagagtcgccacccgacacggtggctactgaaaatggaagtgcagcaggagcctcaggtggtcggccagccagagcgtcttatgtgcctcctcacttgcgaaaccgtcctcaagtagcggctgctgcacccaaagcggaagctgggggtctaggcaaggccgggaatgggtccggttggggtgcaagtccggcggtgaatcattcagccagttgggggaactcaaatggttcaggtcggagctatggaggtggcggacgaggccaaagggggggatgggagagagaagctaatcccttcgctaacgacgaaccagtctcggaggcaatctttgaggcagagaatactggtatcaacttcgatgcgtacgaggacattcctgtagagacgagtggtaataacataccacctccggtgaacacattcgccgaaattgacctgggaccggcgctgaacgaaaacatcagaagatgcaagtacacgaagccgactcccgtgcaaaagtacgctataccgattagtttgcatggtcgtgatttgatggcatgtgcacagacggggtcagggaagacggctgcgttttgttttccaattatcgcagggattatgaggaacactcctccaggccgtcctcggggtggaaggaaggcattgccgttggctctgatattgtcgcccacgagggagctgtcttgccagatcagcgacgaagccaagaagtttgcgtatcagaccggcattagagtagtggtcgcttatgggggggctcccgttcataatcagcttagagagatggaaagaggtgtagacatcttagttgccacccctgggcgtttgagtgatctcttggaaagggctagagtatccctgtctatggtgcgatacttggcgctagatgaggctgatcgaatgctggacatgggtttcgaaccccagattcgtagaatagttgagcagatggatatgccaccggctggtgaacgccagacaatgctgttcagtgctacatttcctcgagaaatacagagactagcatcggatttcttgtcgaactacattttccttgctgtgggcagggtaggatccagtacggatctaatcgtgcaacgggtagagtatgtgcaagatgtggacaagcgtagcatgctgatggaccttattcatgctcaaagcgccttggctccgcctgggcagcaaactttgacgttagtctttgtggagactaagaaaggagcagatgctttagaggactggctgtgccgcctcggattcccagctaccacaatccacggtgatcgtagccagcaggagcgagaacatgccttgagatcttttaggacgggagtgacgcccattctcgttgctacggatgttgccgcccggggtcttgatattccacatgttgcccatgtcgtgaatttcgacctccctagtgatattgatgattacgtgcatcgcattggtcgtactgggcgtgcgggaaagagtggtgtggcaactgctttcttcaacgagaaagaccaggcgttagcgcgaccgctgacagagctgatgacagaatctaaccaggaggtgcctggatggttgactaactacgctacgagagctagttatggaggtggtggtaggaacagacggtcgggaggaggatcgagatttggtggccgtgatttccgtagggaaggcggcagaggaggtggagggggccaccaccacgggggatatggtggtggcggtggtggttatggaggtggaggatatggaggtggtagtagtgcatgggattag

SEQ ID NO: 141 - protein, 600 aa, Physcomitrella patens
MPSTWAESPPDTVATENGSAAGASGGRPARASYVPPHLRNRPQVAAAAPKAEAGGLGKAGNGSGWGASPAVNHSASWGNSNGSGRSYGGGGRGQRGGWEREANPFANDEPVSEAIFEAENTGINFDAYEDIPVETSGNNIPPPVNTFAEIDLGPALNENIRRCKYTKPTPVQKYAIPISLHGRDLMACAQTGSGKTAAFCFPIIAGIMRNTPPGRPRGGRKALPLALILSPTRELSCQISDEAKKFAYQTGIRVVVAYGGAPVHNQLREMERGVDILVATPGRLSDLLERARVSLSMVRYLALDEADRMLDMGFEPQIRRIVEQMDMPPAGERQTMLFSATFPREIQRLASDFLSNYIFLAVGRVGSSTDLIVQRVEYVQDVDKRSMLMDLIHAQSALAPPGQQTLTLVFVETKKGADALEDWLCRLGFPATTIHGDRSQQEREHALRSFRTGVTPILVATDVAARGLDIPHVAHVVNFDLPSDIDDYVHRIGRTGRAGKSGVATAFFNEKDQALARPLTELMTESNQEVPGWLTNYATRASYGGGGRNRRSGGGSRFGGRDFRREGGRGGGGGHHHGGYGGGGGGYGGGGYGGGSSAWD

SEQ ID NO: 142 - DNA, 1671 bp, Populus trichocarpa
atgttgtcaacaattctaagaagatcatcctcttcttatgcacccttttcttcatttcttacttctccaaccatatctagagactttcatgtaaaatctgggccgttggattttaaggcgagttcggtgactcaagctgggatcgctgtagctgattatggctctgatgaggagaaagggaaagggagcgaagaagggcttgaaatttcaaatttagggatttctaaagagattgttaactctttagctaaaaaagggataactaaactgtttcccattcagaaagctgtgcttgaaccggcaatgcaagggaaggacatgtttggccgagctcgaacaggaacaggaaaaacacttgcttttggaatccctatactcgataaaattatagaatttaacaagcaacatgggaaagggaggaacccgttggcaatggttatggctccaacaagagaacttgcaagacaagtacagaaggagtttcatgattctgcgcctagtttggataccatatgtttatatgggggtgttcctatttcaagccaaatgagggagcttgaatatggtgttgatgttgttgttggcacacctggtcgtattattgatctgatgaagaggggttcgcttaatttgtcagaaattaagtatgttgttcttgacgaagctgatcagatgcttggtgtgggatttgttgatgatattgagacaatcttgtcaaggttacctaagaagcggcatagcatgtgcttctctgctacaatgccaagttggatcaaacaacttgttaggaagtacctaaaagatccgctgactattgatcttgttggagattctgatagaaagctggctgatggaattaccctctattcaatagcttcagacatgtatgcaaaagcatcaattcttggtcctctgattacagaacatgcaaaaggaggaaagtgcattgtttttactgaaacaaagcgtgatgctgatcgattagcatatgccatggcaaagaaccataaatgtgaggctttacatggagatatttcacagaatgtgagagaaaggacactttcaggcttccgagagggacatttcaatattctagttgccactgatgttgcggctcgtggtcttgatgtccctaatgttgatctgataatacattatgcacttcctagatgttcagagacttttgttcatcgatctggccgtactggtcgtgctgggaagaagggaactgcaattcttatttatactcaagatgatgccaggcaagtcaagttaattgaacgggacacagggtgcagattttcggagctccctaaaatcgctgtcgatggtgcaagcttagacatgcacaatgacttgggtcgtggacgatctaactcatctggagggtttggtaaccgcggatatggatctgggcaaggctccaggaattctggctttggccgttctaatggtcaattttctggatccagtcaaggtggttataacagaaacaaaacagggaattttggtcgttctggcagctttggtgagtcgggtagatcagaccgttcaagcacttttggggactttggttcaggccgttcaagcacttttggggactttggttcaggacgttctagtggaaagcagaaggttcctgcttttgatccttttggggactctgactag

SEQ ID NO: 143 - protein, 556 aa, Populus trichocarpa
MLSTILRRSSSSYAPFSSFLTSPTISRDFHVKSGPLDFKASSVTQAGIAVADYGSDEEKGKGSEEGLEISNLGISKEIVNSLAKKGITKLFPIQKAVLEPAMQGKDMFGRARTGTGKTLAFGIPILDKIIEFNKQHGKGRNPLAMVMAPTRELARQVQKEFHDSAPSLDTICLYGGVPISSQMRELEYGVDVVVGTPGRIIDLMKRGSLNLSEIKYVVLDEADQMLGVGFVDDIETILSRLPKKRHSMCFSATMPSWIKQLVRKYLKDPLTIDLVGDSDRKLADGITLYSIASDMYAKASILGPLITEHAKGGKCIVFTETKRDADRLAYAMAKNHKCEALHGDISQNVRERTLSGFREGHFNILVATDVAARGLDVPNVDLIIHYALPRCSETFVHRSGRTGRAGKKGTAILIYTQDDARQVKLIERDTGCRFSELPKIAVDGASLDMHNDLGRGRSNSSGGFGNRGYGSGQGSRNSGFGRSNGQFSGSSQGGYNRNKTGNFGRSGSFGESGRSDRSSTFGDFGSGRSSTFGDFGSGRSSGKQKVPAFDPFGDSD

SEQ ID NO: 144 - DNA, 1704 bp, Sorghum bicolor
atggcgtcgtacggtagcagtggcggaggcggcgaccgcgtgcccggggtgggcgtgctcgccgaggcggtggacgggctcgagatcggcggcgacggggagaggcggctggacaagtacgacatcccggtggaggtgagcggggagggcgcgccggcccccgccgacgggttcgaggcggccgggctggcggaggccgtgctccggaacgtggcgcgctgcggctacgacaaccccacgcccgtgcagcgctacgccatgccgatcgtcatggccgggagggacctcatggcgtgcgcgcagaccgggtccgggaagacggccgcgttctgcctccccgtcgtgagcggcctggtggtgccgccggcgggaggagggagcgggtacgggtacggacggcgagacaggggctcgttcgatcgcgtcgccaagccacgagcactcgtcctcgcgcccaccagagagcttgcagcacagattaacgaggaggccaggaagttttctttccaaacgggactcagagtcgtggtagcttatgggggaacaccaatgtataaccagctgcgtgatctagagaggggtgttgatcttcttgtggctacacctggacgccttgtggacatggttgagcgatcacggatctcgcttgagggaattaagtacctggtaatggatgaggctgacagaatgctggatatgggatttgagcctcagataagaaagatagttgacatgatgaatatgccaaaaaagtctgtaagacaaactatgctcttcagcgcaactttcccccctgaaatacagaggctggcttctgatttcttgtacaattacatatttgttactgtcgggagggttgggtcaagcactgacctgattgagcagaaacttgagtttgttaatgatggggagaaaagaggcttcctgatagaccttttgcagaagcaatctgctggtgtggccaatagcaagctgcagcaacccctaacattggtctttgtggagacgaagcgggaagctgattcactgaggtattttctacagtcaaaaggtttcccagcaacagcaatccatggtgacagaacacaacaggagcgggagagcgcactgaaatccttcaagagtggcaccactcctataatggtcgccactgatgtagcttcaaggggtctggatgtcccgaacgtggctcatgtgatcaattacgatctccccaagagcatcgaggattacgtccacaggatcggaagaactgggagagctggaaaggctgggattgccaccgctttcttcaccgagtcgaaccaccccctggcaaagggcctgctggagctgatgactgaggcgaagcgggatgtgcctgagtggctcgtggagtatgcaaacaggccgtgctatggagggtccagctatggcggaagaggccgaaggggcggcggagggtttggcggaagagactatcgacgcagcagtgattatggctatggggttgacgatagtggctattccagccgcggtggcagctactctggtggtggcggctattccagccgcggtggcagctactctgccggcggttctcgtggtggtcgcgcaaactatagtggtggtggagcttcctacggatcaagtgctcctcctccccggtactacccgtcgtaccccatgggcaccactgacatcagcgcctctggctgggactag

SEQ ID NO: 145 - protein, 567 aa, Sorghum bicolor
MASYGSSGGGGDRVPGVGVLAEAVDGLEIGGDGERRLDKYDIPVEVSGEGAPAPADGFEAAGLAEAVLRNVARCGYDNPTPVQRYAMPIVMAGRDLMACAQTGSGKTAAFCLPVVSGLVVPPAGGGSGYGYGRRDRGSFDRVAKPRALVLAPTRELAAQINEEARKFSFQTGLRVVVAYGGTPMYNQLRDLERGVDLLVATPGRLVDMVERSRISLEGIKYLVMDEADRMLDMGFEPQIRKIVDMMNMPKKSVRQTMLFSATFPPEIQRLASDFLYNYIFVTVGRVGSSTDLIEQKLEFVNDGEKRGFLIDLLQKQSAGVANSKLQQPLTLVFVETKREADSLRYFLQSKGFPATAIHGDRTQQERESALKSFKSGTTPIMVATDVASRGLDVPNVAHVINYDLPKSIEDYVHRIGRTGRAGKAGIATAFFTESNHPLAKGLLELMTEAKRDVPEWLVEYANRPCYGGSSYGGRGRRGGGGFGGRDYRRSSDYGYGVDDSGYSSRGGSYSGGGGYSSRGGSYSAGGSRGGRANYSGGGASYGSSAPPPRYYPSYPMGTTDISASGWD

SEQ ID NO: 146 - DNA, 1815 bp, Solanum lycopersicum
atgtcaatgtcgtgggctgattctgtttctgcagccgagaatctggctggagctccgtctaagtcagcatatgttccaccacatttgcgaaacagaccttcaactgatcctcctgcacaggcttcgtatgctggggctgctgcatcattaggtaatgaccatagtggttatggtgtcccaaatatggttgggagtcgttggagtggtcaaaggaatgaataccaatctggttatgctggtggaggaggacgtggtggtggttggaatggaagaagtggtggttgggatcgtgggagggttcgggaagttaacccctttacaaatgatgatagtgaacctgttactgaacaagaaagttctgcgatcaattttgatgcatatgaggatattccagtggaaacaagcggggataatgtgccccctcctgtgaatacttttgcagagattgatttaggtgaagctgtcaatgaaaatataaggaggtgcaagtatgttgagccgacccctgtgcaacggcatgctatacctatttcactcgcagggagggatttgatggcttgtgctcatactggttctggaaaaactgctgctttctgcttcccaatcataagtgggatcatgaggggccaatttcctagacctcctcgtccacgtatggcatttcctctagctcttattctctccccgactagggagctctcatgccaaattcatgacgaggctaaaaagttttcatatcaaactggcgtcagggtggttgttgcctatggtggtgctcctataaaccaacagcttcgtgagttagagagaggtgtgcatattcttgtagcaacccctggacggttggtagatttacttgagagagcaagagtctcgttgcagatgataaggtatttggctctagacgaggctgaccggatgcttgacatgggttttgaacctcaaataaggaaaatagtgcaacagatggacatgcctccgccaggtgtgcgacagaccatgcttttcagtgccacttttccaaaagagattcagagactggcctcagattttctatccagttatatctttttggccgtcggaagggtcggctctagcacagatttgattgtccaacgagttgaatatgttcaagagactgacaagagaagtcacttgatggatcttcttcatgcgcagaaggaaaatggtgttcatggcaagcaagctcttacccttgtttttgtggagactaagaagggagctgatgcactggagcattggctttgtatgaatggtttccctgctgctgctattcatggtgatagaactcagcaggagagagagcatgccctcagatccttcaaaactggttacacaccaatcttggttgcaacagatgtggcagcacgtggtctcgatatcccccatgttgcacatgttgttaactttgatctgccaaatgacattgatgactatgtgcaccgtattggaagaactggacgagcaggaaaaacaggtttagctactgccttcttcaacgagaacaattcttcacttgcaagatcactatccgacctgatgcaagaagcaaaccaagaagtacctgcttggctctctcgctttgctgctcgatccacttatggaggcaagaatcgtcgtggtggagctcgttttggtgctcgtgactttcgaagagattcctcttataaccgaggtgctagtggtggttctaccgactattatggtggtggtgccaatatgaacagtggctatgcatctggggggtataatgcatcgtatggaacagcaggcgtgaccagtgcatgggactaa

SEQ ID NO: 147 - protein, 604 aa, Solanum lycopersicum
MSMSWADSVSAAENLAGAPSKSAYVPPHLRNRPSTDPPAQASYAGAAASLGNDHSGYGVPNMVGSRWSGQRNEYQSGYAGGGGRGGGWNGRSGGWDRGRVREVNPFTNDDSEPVTEQESSAINFDAYEDIPVETSGDNVPPPVNTFAEIDLGEAVNENIRRCKYVEPTPVQRHAIPISLAGRDLMACAHTGSGKTAAFCFPIISGIMRGQFPRPPRPRMAFPLALILSPTRELSCQIHDEAKKFSYQTGVRVVVAYGGAPINQQLRELERGVHILVATPGRLVDLLERARVSLQMIRYLALDEADRMLDMGFEPQIRKIVQQMDMPPPGVRQTMLFSATFPKEIQRLASDFLSSYIFLAVGRVGSSTDLIVQRVEYVQETDKRSHLMDLLHAQKENGVHGKQALTLVFVETKKGADALEHWLCMNGFPAAAIHGDRTQQEREHALRSFKTGYTPILVATDVAARGLDIPHVAHVVNFDLPNDIDDYVHRIGRTGRAGKTGLATAFFNENNSSLARSLSDLMQEANQEVPAWLSRFAARSTYGGKNRRGGARFGARDFRRDSSYNRGASGGSTDYYGGGANMNSGYASGGYNASYGTAGVTSAWD

SEQ ID NO: 148 - DNA, 1911 bp, Triticum aestivum
atgcgatcttcatgggctgattcagttgcgaacgccgaggaatcggcgcccgcgactggtgctgctcccgcccctgttgccaatcaccagaactcgcgtcccacacgcagctcttacgtccctcctcacctccgtggcggtggccgctcaccagagaatcaagtgccagctgcagctccaacaccagctggcgcttacccctcaggtgctgtgcagccttctggtgggtacgcagctgctgttggtggcactcgctgggctgcccctcctggtgctggtagcgctggcgtaggtgttgtccgccagggtggtggtggacgtggtgctgttggtggcgccggcggtggctggaactcccgccctggtgggtggggggaccgcagggaccgtgaaccaaacccttttggcgatagtgagccggcggctgtggatgttgactttgagagtcaacagaacacaggcatcaattttgatgcctatgaggacattcctgtggagacaagtggccacgatgtgcctccagcagtcaacacgtttgcagagattgacttgggtgatgcactgaatgagaatatacggaggtgcaagtatgtgaggcctacacctgtgcagcggcatgccattccgattgtcattggaggcagggatctgatggcctgcgctcagactgggtctgggaagacagctgctttttgtttcccgatcatcagtgggatcctaaagtcaaggccaccacagaggccaagagctaggactgcatttcctcttgctctgatattatctcctactcgcgagctatcagtccaaattcatgaagaagcaaagaaatttgcataccagactggtgttaaggcttgtgttgcatatggtggagcaccaattcatcagcagttgagagaactggaaagaggtgttgatatactagtggcaactcctggtcgtttgatggatctgctggagagagctagagtatcactgcaaatggtgaattacttggctcttgatgaagctgaccggatgctcgatatggggtttgagccacagatacgcaagattgttgagcagatggacatgccccctcgtggtgtgagacagaccatgctgttcagtgctacttttccaaaggagatacaacgcctggcatcagatttccttgcagactacatcttccttgctgttggaagagttggttcaagtaccgatttgattgctcaaagggtggagtttgtccttgaagcggataaaagaagttacctcatggaccttattcatgcgcagaaggctaatgatgttcctggaaagaattctcttactttggtcttcgtggagacaaagaggggcgctgatgctctggagaactggctgtatacaaatgggttccctgcaacaagtattcatggagatcgtacacaacaggaaagggagtatgcgctgagatccttcaagagtggagcaactcccatcctggttgcaactgacgttgctgctcgtgggcttgacattccagatgtcgcccacgtcatcaattttgatctgccaaatgacattgatgactatgttcaccgcattggaagaactggaagagctgggaagtctggtctggcaactgcatttttcaatgagggcaacatgtcactggccaggccgttatgtgaactgatgcaggaagccaatcaggaggttcctcagtggctggagcgctattctgcccgttcctcattcggaggcggcggaggaggcagaaaccgcaggtcaggaggcggcggtggtgctcgatttggtggacgtgacttccgtcgcgacacgaggggcggtggcggtggaggaggtggcggttacggcggtggtggtggtggcgggtacggtggtggtggaggttatggtggaggtgcgtctagctcgtgggactga

SEQ ID NO: 149 - protein, 636 aa, Triticum aestivum
MRSSWADSVANAEESAPATGAAPAPVANHQNSRPTRSSYVPPHLRGGGRSPENQVPAAAPTPAGAYPSGAVQPSGGYAAAVGGTRWAAPPGAGSAGVGVVRQGGGGRGAVGGAGGGWNSRPGGWGDRRDREPNPFGDSEPAAVDVDFESQQNTGINFDAYEDIPVETSGHDVPPAVNTFAEIDLGDALNENIRRCKYVRPTPVQRHAIPIVIGGRDLMACAQTGSGKTAAFCFPIISGILKSRPPQRPRARTAFPLALILSPTRELSVQIHEEAKKFAYQTGVKACVAYGGAPIHQQLRELERGVDILVATPGRLMDLLERARVSLQMVNYLALDEADRMLDMGFEPQIRKIVEQMDMPPRGVRQTMLFSATFPKEIQRLASDFLADYIFLAVGRVGSSTDLIAQRVEFVLEADKRSYLMDLIHAQKANDVPGKNSLTLVFVETKRGADALENWLYTNGFPATSIHGDRTQQEREYALRSFKSGATPILVATDVAARGLDIPDVAHVINFDLPNDIDDYVHRIGRTGRAGKSGLATAFFNEGNMSLARPLCELMQEANQEVPQWLERYSARSSFGGGGGGRNRRSGGGGGARFGGRDFRRDTRGGGGGGGGGYGGGGGGGYGGGGGYGGGASSSWD

SEQ ID NO: 150 - DNA, 1839 bp, Volvox carteri
atggcctttcagggacctggtggtggaggacaatatgtgcctccacacctgcggggcatggctatgggggctccacctccacctcctcctcctggacctgaccgtgatcgaggcggccgcggtggttatggcggtggcggtggctacggtggccctcgcggtggtggtggtgcctatggtggtggtcgcggtggctacggtggcagttttggcgatcgccgggccggctttggccagccgcgcgagggcggcggacctggtgggtcgggcaatggcgcgaaacgcgtcaagtatttaggcggtatgggctttaaccgaccttatgacgatcctttcaagaaggcagagcaggagaaggctgagattgacgcgctttacggcgctgagaacaccggcattaacttcgatgcttatgaggagattcccgtcgagaccagcggcaaggacgttccgcaaccagtgcacagcttcgaggagcttaatttgccgcagtgcatgatggacaacataaagcgctgcaagtttaccaagcccacgcctgtgcagaagcattctattaccattggtttggcaggacgagacttaatggcttgcgcacagacgggctccggcaagacagctgctttttgctttcccatcatcgcgtctatgctcttgaagggttaccagcctgcggctggccgcaacagccggaaagcgctaccaggcgcactggtgttggctccaacgcgcgagctgacgtcccagatttacgacgaagcgcgaaagttcacttacatgaccggcctgcgccctgtggtcatatacggtggtgctccagcacccaaccagctgcgtgacctggagcgcggctgtgacatccttgtggctacacccggccgcctcagcgacttcatcgagcgtgggcgtgtcggcctgtcgtcgatcctgtttctctgcttggatgaggcagatcgcatgttggatatgggtttcgagccgcagatccggcgtatcgtggagcaggaggacatgccgcctgttggccagcgtcagacgctgatgttcagcgccactttccctaaggagattcagcgattggcagcagatttcctgagcaactatgtcttcctcactgttggccgtgtgggctcctccaccgacctcatcgtgcagcacatcgagtatgtgtcgtccgatgagaagcagaatactttgctggaccttatcagcacggtcgagggtctgacgcttgtattcgtggagacgaagcgcggggcggacgagctggagcgcattctgacgcgcaaccaactgccagccacatcgatccacggtgatcgctcgcaggagcagcgcgagatggcgctgcgcagctttaagagcgggaagacgcccgtcatggtggctaccgacgtggctgcccgtggtctggatattcctcacgtgacccacgtgatcaactacgacctgcctaaggacatcgatgactacgtgcaccgcattggacgcacgggacgcgctggccacaagggtcttgccacggcctttttcactgatgcggatgcgccattggctcgctcattggtggaggtgctgacggagacgaaccaggcagtacccggctggctgcagaactacgctgcccgcacgcctggttacggccaaaagagccgccgcggtggtggtcgttttggcggccgcgacttccgcaaggataattacggtggtggcggtggctatggcggaggcgacaaccgcggcggcggtggctatggtggcggtggctacggcagcggcagcggcggcggtggttacggtggtggcggctacggtggcggctgtgagttattggtgtag

SEQ ID NO: 151 - protein, 612 aa, Volvox carteri
MAFQGPGGGGQYVPPHLRGMAMGAPPPPPPPGPDRDRGGRGGYGGGGGYGGPRGGGGAYGGGRGGYGGSFGDRRAGFGQPREGGGPGGSGNGAKRVKYLGGMGFNRPYDDPFKKAEQEKAEIDALYGAENTGINFDAYEEIPVETSGKDVPQPVHSFEELNLPQCMMDNIKRCKFTKPTPVQKHSITIGLAGRDLMACAQTGSGKTAAFCFPIIASMLLKGYQPAAGRNSRKALPGALVLAPTRELTSQIYDEARKFTYMTGLRPVVIYGGAPAPNQLRDLERGCDILVATPGRLSDFIERGRVGLSSILFLCLDEADRMLDMGFEPQIRRIVEQEDMPPVGQRQTLMFSATFPKEIQRLAADFLSNYVFLTVGRVGSSTDLIVQHIEYVSSDEKQNTLLDLISTVEGLTLVFVETKRGADELERILTRNQLPATSIHGDRSQEQREMALRSFKSGKTPVMVATDVAARGLDIPHVTHVINYDLPKDIDDYVHRIGRTGRAGHKGLATAFFTDADAPLARSLVEVLTETNQAVPGWLQNYAARTPGYGQKSRRGGGRFGGRDFRKDNYGGGGGYGGGDNRGGGGYGGGGYGSGSGGGGYGGGGYGGGCELLV

SEQ ID NO: 152 - DNA, 1245 bp, Oryza sativa
atggcaggaatggcacccgaaggctcccagtttgatgctaagcactatgacagcaagatgcaggaactactgcaccaaggtgacaatgaggaattcttcacttcatatgatgaagtttttgagagttttgatgacatgggcctccaagagaaccttctcagaggcatctatgcttatggttttgagaagccatcagctattcagcaaagggggattgttcccttctgcaaagggcttgatgtgattcagcaggctcaatctggaacaggaaaaactgctaccttctgttctgggatcctgcagcaacttgactatggattggtggagtgccaatccctggtccttgcaccaacacgtgagcttgcccagcaaattgaaaaggtcatgcgtgctcttggtgactacttaggtgtcaaggtgcatgcctgtgttggtggaacctctgtccgtgaggaccaaaggattcttgctagtggtgtgcatgttgttgttggcacacctggacgtgtgtttgacatgctacgtcggcaatctctccgcccagaccacattaagatgtttgtgctggatgaagctgatgagatgctctcccgtggtttcaaggatcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctag

SEQ ID NO: 153 - protein, 414 aa, Oryza sativa
MAGMAPEGSQFDAKHYDSKMQELLHQGDNEEFFTSYDEVFESFDDMGLQENLLRGIYAYGFEKPSAIQQRGIVPFCKGLDVIQQAQSGTGKTATFCSGILQQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 154 - DNA, 2133 bp, Populus trichocarpa
atgaaacgctcattcgacgacattggcgtctccaaaacccaaagcaaacctgtcttcttgaccaaagctcaacgcgagcaattagcccttcaacgccgccaagaagaaatcgaacaacaaaagaaacgccaacaactcctcctctcccaaacccgcccttccaactcggagtccgacaaacccccatccaattctgaccgccgtgaccagcgtgacagagacagagagcgcgagatggagagagatagggaaagggaaagggaaagggaaagggaaagggaaagggagcgggaacgggaacgcgaacgctcctcgcggcgcaacagagaacgcgaacgtgaagaggaagcaaaggcgcgtgagcaagccaggctggataaattagcggagagagagcgagagaaggagctggatgcgattaaagagcaatatctagggtcgaaaaagcctaagaagagagtaataaaacctagtgagaagtttcgcttctcttttgattgggaaaacacggaagacacttctagagacatgaatattttgtatcaaaaccctcatgaggcacaacttttgttcggtcgagggtttagggctggaatggaccggagagagcagaaaaaacttgctgcaaagaatgagaaggattttagagacgaacttcgaaagaaagaaggtgtagagaagaatccagaagaggcggctgcccaaaaattgaaggaagaagctgctgataggtatgacacttttgatatgcgtgttgataggcattggtccgagaagaagcttgaagaaatgactgagagagattggaggatatttagggaagattttaatatttcttataagggttccaagattccgcggcccatgaggagttgggcagagagtaagttgagtagcgagttgttgaaggcagtggagagggtagtgtataagaagccgtcgcctattcaaatggcagcgattccactgggattgcaacagcgggatgttatcgggattgctgagactggttctggtaagacttgtgcttttgttttgcctatgttgacttatatttctaggttgcctccaatgagtgaggagaatgaggctgaagggccttatgcagttgttatggcacctacgcgtgagttggcacagcagattgaggatgaaactgttaagtttgcacattatttgggtattaaagttgtttctatcgttggtgggcagtctattgaagagcaagggtttaggattaggcaaggttgtgaggtggttattgctactccaggtcgtttgattgattgtttggagaggcgttatgcagtgttgaatcagtgtaattatgttgtgcttgatgaggctgataggatgattgatatgggttttgaaccccaggttatgggagtgttggatgcaatgccatcgagcaatttgaagccagaaaatgaagatgaagagcttgatgagaaaaagatttatcgcaccacttatatgtttagtgctactatgccacctgcagtggagcggcttgcaaggaagtacttgagaaaccctgttgtggtcactattggcactgctgggaaggccactgacttgatatcccaacatgtgataatgacgaaggaatcggagaagtccagcaggttgcatagattgcttgatgaacttggagataagactgcaattgtttttgttaacactaaaaagaatgcagatatggtggccaagaatttggacaagcatggctatcgtgtgacgactttgcatggtgggaagtcccaggagcagagggaaattagccttgaaggttttaggaccaaaagatacaatgttcttgtggcaacagatgttgcaggtcgtggtattgatatacctgatgtggcccatgtcattaattatgatatgcctggaaatattgaaatgtatactcaccgtattggacgaacaggccgtgctggaaagacaggtgtggcttcaacattcttaactcttggggacacagatgttttttatgatctcaagcaaatgcttatccagagtaacagttctgtgcctcctgagttggctaggcacgaggcttcaaaattcaagccaggaacaattcctgatagacctcctagacgaaatgacactgtttttgctcactga

SEQ ID NO: 155 - protein, 710 aa, Populus trichocarpa
MKRSFDDIGVSKTQSKPVFLTKAQREQLALQRRQEEIEQQKKRQQLLLSQTRPSNSESDKPPSNSDRRDQRDRDREREMERDRERERERERERERERERERERSSRRNREREREEEAKAREQARLDKLAEREREKELDAIKEQYLGSKKPKKRVIKPSEKFRFSFDWENTEDTSRDMNILYQNPHEAQLLFGRGFRAGMDRREQKKLAAKNEKDFRDELRKKEGVEKNPEEAAAQKLKEEAADRYDTFDMRVDRHWSEKKLEEMTERDWRIFREDFNISYKGSKIPRPMRSWAESKLSSELLKAVERVVYKKPSPIQMAAIPLGLQQRDVIGIAETGSGKTCAFVLPMLTYISRLPPMSEENEAEGPYAVVMAPTRELAQQIEDETVKFAHYLGIKVVSIVGGQSIEEQGFRIRQGCEVVIATPGRLIDCLERRYAVLNQCNYVVLDEADRMIDMGFEPQVMGVLDAMPSSNLKPENEDEELDEKKIYRTTYMFSATMPPAVERLARKYLRNPVVVTIGTAGKATDLISQHVIMTKESEKSSRLHRLLDELGDKTAIVFVNTKKNADMVAKNLDKHGYRVTTLHGGKSQEQREISLEGFRTKRYNVLVATDVAGRGIDIPDVAHVINYDMPGNIEMYTHRIGRTGRAGKTGVASTFLTLGDTDVFYDLKQMLIQSNSSVPPELARHEASKFKPGTIPDRPPRRNDTVFAH

SEQ ID NO: 156 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 157 - DNA, 54 bp, Artificial sequence
  primer: prm14820
ggggacaagtttgtacaaaaaagcaggcttaaacaatgggtcgcagtatgcttc

SEQ ID NO: 158 - DNA, 50 bp, Artificial sequence
  primer: prm14821
ggggaccactttgtacaagaaagctgggtacgaagaaaagaccagcaaat

SEQ ID NO: 159 - protein, 9 aa, Artificial sequence
  signature pattern
  VARIANT (1)..(1): / replace = "Ile" / replace = "Val" / replace = "Met" / replace = "Phe"
  VARIANT (2)..(2): / replace = "Ile" / replace = "Val" / replace = "Met" / replace = "Phe"
  VARIANT (7)..(7): / replace = "Lys" / replace = "Glu" / replace = "Asn"
  UNSURE (8)..(8): Xaa can be any naturally occurring amino acid
  VARIANT (9)..(9): / replace = "Ile" / replace = "Val" / replace = "Met" / replace = "Phe" / replace = "Gly" / replace = "Ser" / replace = "Thr" / replace = "Asn"
LLDEADRXL

SEQ ID NO: 160 - protein, 8 aa, Artificial sequence
  motif 10
  misc_feature (2)..(3): Xaa can be any naturally occurring amino acid
FXXPSPIQ

SEQ ID NO: 161 - protein, 8 aa, Artificial sequence
  motif 11
  misc_feature (2)..(2): Xaa can be any naturally occurring amino acid
AXTGSGKT

SEQ ID NO: 162 - protein, 8 aa, Artificial sequence
  motif 12
  misc_feature (7)..(7): Xaa can be any naturally occurring amino acid
PTRELAXQ

SEQ ID NO: 163 - protein, 4 aa, Artificial sequence
  motif 13
TPGR

SEQ ID NO: 164 - protein, 10 aa, Artificial sequence
  motif 15
VLDEADRMLD

SEQ ID NO: 165 - protein, 7 aa, Artificial sequence
  motif 15
MFSATWP

SEQ ID NO: 166 - protein, 11 aa, Artificial sequence
  motif 16
  VARIANT (6)..(6): / replace = "Ser"
ATDVAARGLDI

SEQ ID NO: 167 - protein, 9 aa, Artificial sequence
  motif 17
RIGRTGRAG

SEQ ID NO: 168 - DNA, 1329 bp, Medicago truncatula
atgggttcattgccaaatttagaagcacctcctccttcaagttcaagaatttcaaccgttgttccagcaacaccacgatgtgaagaaaaaggtgaacacaacctaaactacatggacttgttgatgaagcttcactatgtccggtccatttatttcttcgattctgaagctgttcaaggccttacaatatccgatttaaaaacaccgatgtttccactgctggatttgtactcgcatgttgccggtcgagttagaatagccaaatccggcagaccgtttatcaaatgcaatgatgccggtgtgcgaatcgcggagtcgcagtgtgataaaacgctgagggaatggttggatgaaaatgagtattcagttgatgaacttgttcatgatcatgtgcttggtcctgatcttgctttttctcctttggtttttgtcaagttcacgagtttcaaatgtgggggactctctgttggactaagttgggctcacatccttggagatgcattttcagcttttaatttcatcaccaaatggagtcacatactagctggtcaatcccaaccaaaatctcttcacattccaaatcttgtcaaacctcaattcctatccaattttgtttttgataatcctatttccatcaaaaatgaaaatgttgttggggaatattggcttgctgcaaatgattgttatgtccctagtcacacatttcacatcacttctagccaacttcaccatttggtaaaaacaaccaaatctattaccaataccgatactaagtattttgaaattatttcagctacgatatggaaatgtatagcacaaataagaggtgacattggaccaaaggttgtgacaatatgtagtaaaaataaaaatacctctaaatgtgctgaaaatgaattcccaacaaatgacatattgttgagcaaaatcgaaacaaatttgcgcccggaggaatataatatattagatttaatgaatctgattggtgagaaaaaaattaatgagaattatgcattggaaaaattggtggagaaaggtgatggaaaagatgatttttttgtatatggagcaaagttaacatttgtagacttggaagaagctgatttatatggtgtaaagcttaatggaaagaaacctattagggcgaattgtgatttacgtggtgtcggtgatcaaggagttgttttggtttttccaggtccagaagatgatgatggtaacaatggaagaatgataaaagtttcattgccagggaaagaacttgaccagttgaaatataagcttgaaagagaatggggtatacaacattatgcaagtctaacattttaa

SEQ ID NO: 169 - protein, 442 aa, Medicago truncatula
MGSLPNLEAPPPSSSRISTVVPATPRCEEKGEHNLNYMDLLMKLHYVRSIYFFDSEAVQGLTISDLKTPMFPLLDLYSHVAGRVRIAKSGRPFIKCNDAGVRIAESQCDKTLREWLDENEYSVDELVHDHVLGPDLAFSPLVFVKFTSFKCGGLSVGLSWAHILGDAFSAFNFITKWSHILAGQSQPKSLHIPNLVKPQFLSNFVFDNPISIKNENVVGEYWLAANDCYVPSHTFHITSSQLHHLVKTTKSITNTDTKYFEIISATIWKCIAQIRGDIGPKVVTICSKNKNTSKCAENEFPTNDILLSKIETNLRPEEYNILDLMNLIGEKKINENYALEKLVEKGDGKDDFFVYGAKLTFVDLEEADLYGVKLNGKKPIRANCDLRGVGDQGVVLVFPGPEDDDGNNGRMIKVSLPGKELDQLKYKLEREWGIQHYASLTF

SEQ ID NO: 170 - DNA, 1392 bp, Medicago truncatula
atgggttcactacctaatttggaaactcctccccaaatttcaagaatttcaacagtagttccagcaacccctcgtggtgaagaaaatagtgcatataatctcaactacatggacctgcttatgaaactccactatatccgatccatatacttgttcaattctaaagcggttcaaaacctctcaatatctgacttaaaagcaccaatgtttcaactacttgattcatactcacatgtttcaggtagggttagaatatcagaatcaggaagaccgtttatcaagtgcaacgacgcgggtgtgcgaatagcagagtcacactgtgagaaaacactgcgtgaatggttggatgagaaagagtactctgttgatgaacttgtatatgatcatgtgcttggtcctgatcttgcattttctcctttggtttttgtcaagttcacattcttcaaatgtggaggactctcagtgggactgagctgggctcacattcttggagatgcattttcagctcgtaacttcatcaccaagtggagtcacaccctagctggtcaagctccaccaaaatctctccacatgccaaatctcactaaacctcaattcttatcgaattctgtttatgataatcccatttccattaaaagggcaacaacaattgaagaatattggctcgctgccactgatagttatgtagctactcacacttttcacatcacttccaaacaacttcatcatttgttaacaacatccacatcaaccaatatcaatatcaataccaagacaaagtattttgaaattatttcagctatgatttggaaatgtataggacaaataagaggaaactttggacctagggttgtgacaatatgtactacaaatatctctaatcgcgctgaaaatgaattcccgacaaatggctcggtgttgagcaaaatcgaaacaagtttatcacctggggaatctgaaatatcagaattagtgaagctaattgctgagaaaaaaatgaacgagaatcatggattggaaaaaatgatggaggaaggtgaaggaaaagatgattttattgtttatggagcaaagttaacatttgtagatttggaagaaggtaatttttatggtgtaaagattaatgggcagaaaccaattttggcaaattgtgattttcgtggtgtgggtgatcaaggagttgttttggttctttcaggaccagaagattacaatggtaataatggaaggatgtcgttctcttgcaagttgcaaccatggaacttccttcgtgagagtgaacagagaggagacacaacaacggcgacaacaatcacaacaacatcgacaacggtctcggtgacaatggccacaacgaacattgcaacaacaacgacattcgtactacgatga

SEQ ID NO: 171 - protein, 463 aa, Medicago truncatula
MGSLPNLETPPQISRISTVVPATPRGEENSAYNLNYMDLLMKLHYIRSIYLFNSKAVQNLSISDLKAPMFQLLDSYSHVSGRVRISESGRPFIKCNDAGVRIAESHCEKTLREWLDEKEYSVDELVYDHVLGPDLAFSPLVFVKFTFFKCGGLSVGLSWAHILGDAFSARNFITKWSHTLAGQAPPKSLHMPNLTKPQFLSNSVYDNPISIKRATTIEEYWLAATDSYVATHTFHITSKQLHHLLTTSTSTNININTKTKYFEIISAMIWKCIGQIRGNFGPRVVTICTTNISNRAENEFPTNGSVLSKIETSLSPGESEISELVKLIAEKKMNENHGLEKMMEEGEGKDDFIVYGAKLTFVDLEEGNFYGVKINGQKPILANCDFRGVGDQGVVLVLSGPEDYNGNNGRMSFSCKLQPWNFLRESEQRGDTTTATTITTTSTTVSVTMATTNIATTTTFVLR

SEQ ID NO: 172 - DNA, 1335 bp, Glycine max
atgggttcgctacccgattttgacactctcccccctctgagctcgaggatttcaacggtggttccagcaacccctcgagaagatgaaaacggtgcgtttcaactcaactacatggacctcctcgtgaagctccattacatacgacccgttttcttcttcacttccgaagccgttcaaggcctctcaatctccgacttgaagaaacctatgttcccgcttctcgacccgtattaccacgtttcgggtcgggtcagaagatccgaatccggacgcccctttgttaagtgcaacgacgccggtgttcgcatcgctgagtcgcactgcgacagaaccctcgaagaatggttccgtgaaaacggaaacggcgccgttgaagggcttgtccatgatcacgtgcttggacctgatcttgccttttctcctctcgttttcgtcaagttcacttggttcaaatgtggaggattatccgtgggattaagctgggctcacgttcttggagatgccttttctgcatttaatttcctgtccaagtggagtcaaatactagcaggtcaagctccaccaaaatctcttcatgtgtcaagtttccctgaacccaaaatctcacataattccattgttgatgaccctccagtttccattaaaaagacaaatattcttggagagtattggctcgctactaattaccacgatgtggctactcactcttttcacatcacttccaaacaacttcaccatttggtaacagccacatttaatcaaaccaatgacaataccaataaggccaagaccaccacctattttgaaattatttcagcattactttggaagtgtatagcaaacataaggggccaaaaaattggaccaaatgttgtgactatatgtactagtgaatctaatcgtgcagaaaacgaattccccaccaatggcttcttagtgttaagcaaaattgaagcagatttttcgactgggaaatatgaaatttcagaattggtgaagctgattgctgagaacaagatggttgagaaccatgtaatggaaaaattggtggaggcagatgaagggaaagaggattttatagtttatggggtaaacttgacgtttgtgaatttggaagaagttaatatttatgatgggatgaatctgaatggacagaaaccaattatggcaaattgtacatttcgtggggtgagtgataaaggggttgttttggttcttccagcaccagaagatgacgaagatggtggtaatggaaggattgttactgtttctttgcctcgtgaagaactatatcagctgaaagataagctaggaggagaatggggcatacactaa

SEQ ID NO: 173 - protein, 444 aa, Glycine max
MGSLPDFDTLPPLSSRISTVVPATPREDENGAFQLNYMDLLVKLHYIRPVFFFTSEAVQGLSISDLKKPMFPLLDPYYHVSGRVRRSESGRPFVKCNDAGVRIAESHCDRTLEEWFRENGNGAVEGLVHDHVLGPDLAFSPLVFVKFTWFKCGGLSVGLSWAHVLGDAFSAFNFLSKWSQILAGQAPPKSLHVSSFPEPKISHNSIVDDPPVSIKKTNILGEYWLATNYHDVATHSFHITSKQLHHLVTATFNQTNDNTNKAKTTTYFEIISALLWKCIANIRGQKIGPNVVTICTSESNRAENEFPTNGFLVLSKIEADFSTGKYEISELVKLIAENKMVENHVMEKLVEADEGKEDFIVYGVNLTFVNLEEVNIYDGMNLNGQKPIMANCTFRGVSDKGVVLVLPAPEDDEDGGNGRIVTVSLPREELYQLKDKLGGEWGIH

SEQ ID NO: 174 - DNA, 1332 bp, Glycine max
atggatcaagagaccgaaccacaacctctgacctcaaagatctcaacagttgtaccagcaaccccgcgaggcgacgaggacggcgcgtaccacctcagcaacatggacctgctcatgaagctgcactacatcagagccgtttatttcttcatcaacgacgcagcgcaagggctctcgatttatgacctcaagaaacccatgttcccgctcctcgaccaggtcgtgcaactctcgggtcggatccgggtttctgaatcgggtcggcccttcttgaagtgcaacgatgctggtgttcgcatcgctgagtaccaccacgaccacacccttggggagtggtttcagaaaaatgggtgctcccttcaaggtctcgtccatgatcatgttcttggccctgaccttggcttctctcctttggtttttgtcaagttcacttggttcaaatgtggagggctctctctaggactcagctggtcccatgttctaggagacgctttttcagccttcagcttcatcaccaagtggagtcaaatactggcgggtcacgcgccgccaaaaatccttccaatgtcaccaactctcaaagaaatccaaaccccacacaataataattcggttaatgcgaataatgggaatcacttttctgtcaaaacagccacaaccatagaagaactttggctcgctacaaacggcataaaaatggttactcacactttccacgtcactgccaaacaacttaaccgtttggtgtcatccacgttcttttcatgtgaccaaaacaaagccaccaaaacctcgtatttcgagattctttcggcgttggtgtggaaacacattgctggcatgagggaagacaccgagccaaaggttgtaacaatttgcacacgtggcatggctaatatcgaattccccaccaatggtttggtgttgagcgttgttgaagccaacgtggcagttggacaatctgacgtgtccgatttggcgaagctgattggcgaggaaaaaagggttgagaatgttgttgtggaaaagttagtggaagagagccaagggaaaggggattttgtggtttatggggcgaatttgacgtttgtggatttggaagaaggtgacatgtacgaggttgtgctgaatggacacaaaccggtcgtgacgaattgcagcatccatggagtgggtgatcaaggtgttgttttggtgcttccgggacttgaagatgaagaaaatgggaggaatattggaagaatggtgactgtttctttgcctgaaaaagaagttgaccagctcaaagagaagctgagaggagaatggggtcctgagtcacttccattctga

SEQ ID NO: 175 - protein, 443 aa, Glycine max
MDQETEPQPLTSKISTVVPATPRGDEDGAYHLSNMDLLMKLHYIRAVYFFINDAAQGLSIYDLKKPMFPLLDQVVQLSGRIRVSESGRPFLKCNDAGVRIAEYHHDHTLGEWFQKNGCSLQGLVHDHVLGPDLGFSPLVFVKFTWFKCGGLSLGLSWSHVLGDAFSAFSFITKWSQILAGHAPPKILPMSPTLKEIQTPHNNNSVNANNGNHFSVKTATTIEELWLATNGIKMVTHTFHVTAKQLNRLVSSTFFSCDQNKATKTSYFEILSALVWKHIAGMREDTEPKVVTICTRGMANIEFPTNGLVLSVVEANVAVGQSDVSDLAKLIGEEKRVENVVVEKLVEESQGKGDFVVYGANLTFVDLEEGDMYEVVLNGHKPVVTNCSIHGVGDQGVVLVLPGLEDEENGRNIGRMVTVSLPEKEVDQLKEKLRGEWGPESLPF

SEQ ID NO: 176 - DNA, 1311 bp, Populus trichocarpa
atggtgccaacaatcctcaaaacatcagtttctggcatcaagctatcatcggttgtgccagccgaagtgacaggtgacaacgaggaccgaaaactaacaaatatggacttggcctttaagctccattatgtcaggggtgtgtcctttttcagtaacgaaacagtccagggtctcacaatatacgacttgaaggaacccatgttttcactgctcgctctctatcctactgcttcgggaagaattcggaaatctgaatcaggcagacctttcatcaagtgtaatgatggtggtgttcggattgttgaagcgcactgtgacaaaaccattgaggaatggttaaagattaacgaccacaaacctcttgatgattatcttgtttacgatcaagttcttggtccagatttaggattctctccattggtctttgttcagttcacttggttcaagtgtggaggaatgtcagtgggactcagctgggcccatgttcttggggatccattctcagcttcaaccttcatcaacacatggggcaaaattatgcaaggtcacgtgccatcaaggtctccccacgtgccaaacactaaaaaatccaaatacccactttcaacgacaagaaggaagccattttccctaaaacgggtcgacccagttggggactcttggttaagtaccaataactgtaaaatggaaactcactctctccatgtcactgcagaacaacttgacgacatactatcagacaatattcgtggtcaaaagcagccaactgagttatcccatttccaagtcctctctgcaataatatggaaatctttgtccaaggttagggaagattcagggccaagaattgtgacaatttgcacaggaaattctcgagtcaatgaccctgaagttccaagcaacaacctggtgtttagcattattgaagcagacttctcggtcgcggaaggagaaatctatgaattagcggaattgattgctgagaagcaggaggaggagaatagcttgatagaagatatagtagagagcgacgaggttgaattcgaccgtatagcatatggaacaaatttgacctttgtggatttggaagaagcaaatatttatgggctggaattgaaggggcagaagcctatttttgctaattattccatcaagggagtcggtgagggaggagttgttttagtgctacctgcagggccaggaaatggcagtgggaaagtcagttctgggaggacagtgacagtgactttgcctgaaaatcaactttcaaggctaatgaatgagctcaagttacactggggtcttgcttga

SEQ ID NO: 177 - protein, 436 aa, Populus trichocarpa
MVPTILKTSVSGIKLSSVVPAEVTGDNEDRKLTNMDLAFKLHYVRGVSFFSNETVQGLTIYDLKEPMFSLLALYPTASGRIRKSESGRPFIKCNDGGVRIVEAHCDKTIEEWLKINDHKPLDDYLVYDQVLGPDLGFSPLVFVQFTWFKCGGMSVGLSWAHVLGDPFSASTFINTWGKIMQGHVPSRSPHVPNTKKSKYPLSTTRRKPFSLKRVDPVGDSWLSTNNCKMETHSLHVTAEQLDDILSDNIRGQKQPTELSHFQVLSAIIWKSLSKVREDSGPRIVTICTGNSRVNDPEVPSNNLVFSIIEADFSVAEGEIYELAELIAEKQEEENSLIEDIVESDEVEFDRIAYGTNLTFVDLEEANIYGLELKGQKPIFANYSIKGVGEGGVVLVLPAGPGNGSGKVSSGRTVTVTLPENQLSRLMNELKLHWGLA

SEQ ID NO: 178 - DNA, 1284 bp, Aquilegia sp
atggtttttggagacgtcgatgacctcatttacgatacaaagttgtcgtcggttggaccagcttctgtgactggaccagatgtatttcaaaatgtttctaacatggatttagccatgaaactacactatcttagaggtgtgtatttctttgaaaaagaagcagtagaaggactcaccatttccaaaatcaaagagtctatgttttattggctagacctttattacatcagttgttcaagggttagaaggtctgagacaacaggtagacctattcttaaatgtaacgattgcggtgtaaggatcattgaagccaagtgtaagatgaacatggatgatttccttcagttgaaggattgttctcttcagaatcgcttggtttacaatcaagtccttggtcctgaattaacattttctcctctggccatgattcagttaacttggttcaaatgtggtggaatgtcagttgggctaagatgggctcatgttcttggagatgcattctctgctacagagtacataaacatatggggacaagtgttggctggtcatcttcaaccatctaggtctatcaaggacccaaaatttcaatttaaagcccaagctcaagttcagaatacagagaagtcattcattccactttctgtgaaacgggtcgacccagttggggactactggataacaccaaataactgcaaaatgggaaccctttccttggaaataagggctgaccaattgactaaactgcagtcagatatatttgaccaaagtcaaaatggtaaaaattcttattttgttcctatttcagctgtaatttggcaatgtttggctagtatcagggaagaacctgaaccaaggactgtgactatatatagaagtgatggggaaaggtatctgggtaataatccgatactaactgtcgtgaaggcggacttctctattgcaaaatctgaaccaaaggaattagctgctttgatcatggatcaaaaggtgaatgagagaaaccaaattgaacagatggtggaaaaggatcaagatatgccggattacattgtctttggagcaaacccgacttttgtggatatggaagaggtcaatctttatgggttggaggtgaacggactgaaacccgtttacgctaattacatgcttcatggggttggtgatgaaggggtcatcttagtacttccagctactaatggaggaaggactgtgacaataactatgccagaaggtcagatttccgagctgaaagctgaaatgaagatgaagtggaacattggctga

SEQ ID NO: 179 - protein, 427 aa, Aquilegia sp
MVFGDVDDLIYDTKLSSVGPASVTGPDVFQNVSNMDLAMKLHYLRGVYFFEKEAVEGLTISKIKESMFYWLDLYYISCSRVRRSETTGRPILKCNDCGVRIIEAKCKMNMDDFLQLKDCSLQNRLVYNQVLGPELTFSPLAMIQLTWFKCGGMSVGLRWAHVLGDAFSATEYINIWGQVLAGHLQPSRSIKDPKFQFKAQAQVQNTEKSFIPLSVKRVDPVGDYWITPNNCKMGTLSLEIRADQLTKLQSDIFDQSQNGKNSYFVPISAVIWQCLASIREEPEPRTVTIYRSDGERYLGNNPILTVVKADFSIAKSEPKELAALIMDQKVNERNQIEQMVEKDQDMPDYIVFGANPTFVDMEEVNLYGLEVNGLKPVYANYMLHGVGDEGVILVLPATNGGRTVTITMPEGQISELKAEMKMKWNIG

SEQ ID NO: 180 - DNA, 1230 bp, Brassica napus
atgaagatctcgtcggtggtacctgcttctatgacaggcgagaacaagccacggcatctcacggccatggacttggccgtgaagctccactacgtccgagctgtttacttcttcaagggtacacgtgacttcaccatcttttacttgaaaaacatcacgtttcctttgctcgacctcccgtgttatgaccatgtgactggtcggatccggcttctcgacaacaaaaacccttcagctcaagccataccttacattcgctgcaacgacagtggcatgcgcatagttgaagctaaagtcgaagggttcacggtccaggagtggctagacttggacgaccgttccatcgaccaccggttccttgtctacgatcacgttcttggtcctgatcttttatactctccactcgtttacctccagataacacagttcaaatgtggtgggctatcagtagggctaagttgggcccatgtactgggagatgtagtttcagcatcaactttcatgaaaacgatgggacaactaaggtcgactcgtggcccatccaaacccgtttacccgaaaaaacccgaactgacccctcatgctaatggtcaagttgatgatgatgggcaggccatttccattaagaaggtggaatcagttggggagtattggttacttagcaataaatgcaagatggggagattcaacattaagtttagcctcgagcaaatcgaccggttgatggccaagtaccaatcttcctcagaggttgatattctgtatgcattgatatggagttcgatactgaatattcgtggggaaaaagacacaaatgttataacaatctgtgaccgtaaaacgtcttcaacatgttggaacgatgacttggtaataagtgtagtggaaaggaaagatgagatgaccgagggatccgaactagcggggctcatagcgaacgagagaaaagaagagaacggtgtgatcaaggggatgatagaaaaagatagaggctattcggattttatcacgtacggtgcaaacttaacgtttgtgaatcttgacatgtgtgacgaacttgagattaaaggagagaagcctgatttcgtgaactacacgattcatggtgtgggggacaaaggagttgtgttggtgtttcccaagggaaagtttgctagggctgtaagtgtggtgatgcctgaagaagagcttgcaaagctgaagattgaggtgaataatatgattatgtag

SEQ ID NO: 181 - protein, 409 aa, Brassica napus
MKISSVVPASMTGENKPRHLTAMDLAVKLHYVRAVYFFKGTRDFTIFYLKNITFPLLDLPCYDHVTGRIRLLDNKNPSAQAIPYIRCNDSGMRIVEAKVEGFTVQEWLDLDDRSIDHRFLVYDHVLGPDLLYSPLVYLQITQFKCGGLSVGLSWAHVLGDVVSASTFMKTMGQLRSTRGPSKPVYPKKPELTPHANGQVDDDGQAISIKKVESVGEYWLLSNKCKMGRFNIKFSLEQIDRLMAKYQSSSEVDILYALIWSSILNIRGEKDTNVITICDRKTSSTCWNDDLVISVVERKDEMTEGSELAGLIANERKEENGVIKGMIEKDRGYSDFITYGANLTFVNLDMCDELEIKGEKPDFVNYTIHGVGDKGVVLVFPKGKFARAVSVVMPEEELAKLKIEVNNMIM

SEQ ID NO: 182 - DNA, 1266 bp, Arabidopsis thaliana
atggagggaagcccagtgaccagtgtcaggctctcttcggtggtgcctgcttctgtggtaggtgagaacaagccacgacagctcacacccatggacttagccatgaagctccactacgtccgagccgtctacttcttcaagggtgcacgtgacttcactgtcgccgacgtgaagaacaccatgtttactctacagtctctactccaatcttatcaccacgtctcaggtcggatccggatgtccgacaacgacaacgacacttcagctgcagccataccttacattcgctgcaacgacagtggcatacgcgtggtcgaggccaacgtcgaagagttcacagtggagaagtggctcgagttggacgaccgttccattgaccaccgattccttgtctacgatcacgttcttggtcctgatcttaccttctcgccactcgttttcctccagataactcagtttaaatgtggtgggctctgtattgggttgagttgggcccatattcttggagacgtgttttcagcatcaacgttcatgaaaacacttggacagctggtatcgggtcatgccccaacaaaaccggtttacccgaaaacccccgaactaacctctcatgctcgtaatgatggtgaagctatttccattgaaaagatagattcggttggcgagtattggttacttaccaataaatgcaagatggggagacacatttttaattttagcctcaaccacattgatagcttgatggccaagtacaccacgcgagaccaacctttctcggaggttgatattttgtatgcattgatatggaagtcgctactgaatatccgcggcgaaacaaacacgaatgttataacaatttgtgaccgtaaaaagtcttcaacctgttggaacgaggacttggtaataagcgtagtggaaaagaatgacgaaatggttgggatatccgaactagctgcactgattgctggtgaaaaaagagaagaaaacggtgcgatcaagaggatgatagaacaagataaaggctcttcggattttttcacgtacggtgcaaatttaacgtttgtgaatcttgatgaaatagatatgtatgaacttgagatcaacggagggaagccggatttcgtaaactacacgattcatggggtcggagacaaaggtgttgttttggtttttcccaagcaaaactttgcaaggattgtaagtgtagtgatgcctgaagaagaccttgcaaaactcaaggaggaggtgactaatatgattatataa

SEQ ID NO: 183 - protein, 421 aa, Arabidopsis thaliana
MEGSPVTSVRLSSVVPASVVGENKPRQLTPMDLAMKLHYVRAVYFFKGARDFTVADVKNTMFTLQSLLQSYHHVSGRIRMSDNDNDTSAAAIPYIRCNDSGIRVVEANVEEFTVEKWLELDDRSIDHRFLVYDHVLGPDLTFSPLVFLQITQFKCGGLCIGLSWAHILGDVFSASTFMKTLGQLVSGHAPTKPVYPKTPELTSHARNDGEAISIEKIDSVGEYWLLTNKCKMGRHIFNFSLNHIDSLMAKYTTRDQPFSEVDILYALIWKSLLNIRGETNTNVITICDRKKSSTCWNEDLVISVVEKNDEMVGISELAALIAGEKREENGAIKRMIEQDKGSSDFFTYGANLTFVNLDEIDMYELEINGGKPDFVNYTIHGVGDKGVVLVFPKQNFARIVSVVMPEEDLAKLKEEVTNMII

SEQ ID NO: 184 - DNA, 1263 bp, Arabidopsis thaliana
atgggtctagttcaagaagagggaagcggtcctgttcatggctttcggttatcaaccgtgagtgcgtccctgccgtcagagacaggtacgacccacgagcccaccggtttagacctcgccatgaagctccactacctaaaggcggtttacatttactcggccgggacagcacgtgacttgactgtgatggacgtgaaggcgcctttgttttcagtgttctaccagatcccttgcatcattggcaggttcaggcgacatgaatcgggacgtccgtacctaaagtgcaacgactgtggcacacgtttcgtggagagtcattgtgatctcactgtggaggagtggctccgtgtaccggaccggtccgttgatgagtctttggtttaccatcaaccagttggaccagatttggcattctctcctttgctctatattcagatgacccggtttagctgcggtggattagctttgggcttaagctgggctcatatcatgggagatccattctctctttctcatttcttcaacttatgggctcaagcctttgctggtgggaagatctactgccccaaaacctctgtcacagagagagactttcaaaacccgacctcaacattcaaaaaaccggattcagtcaaacaggttgacctggttggagatctctgggtcgctccgaataacagcaaaatgacaacattctccttcaatttaacggttaacgatttaaaaacacattttccggtgaacggagacggcgaattcgagattctcactggaatcatatggaaatgtgttgcgacggtgaggggagaatcagctccggtgacgattacggttatcagatcggatccgaagaagttgaagcctagagcggtgagaaatggtcagatgataagttccattcacgtcgatttctcggtggcggaggcgagtttggaggagattgtgaaatcgatcggtgaagcgaaagatgagagggttgtgatcgatgagattgttgatgatgtttcggattttattgtttacggagcgaatttaacgtttgtggatatgagtgaagttgatttttatgaggcgaaagttatggggaaatcgccggaatcggtttattgtaatgttcaggggattggggacgacggagcagtggtggttttaccgggggttgtggaggaggagagggttgtgacggtgacattaccggtggatgagattgagaaggtgaaatgggaaatgaagaaatgtggtttgatcacgccgttagtttaa

SEQ ID NO: 185 - protein, 420 aa, Arabidopsis thaliana
MGLVQEEGSGPVHGFRLSTVSASLPSETGTTHEPTGLDLAMKLHYLKAVYIYSAGTARDLTVMDVKAPLFSVFYQIPCIIGRFRRHESGRPYLKCNDCGTRFVESHCDLTVEEWLRVPDRSVDESLVYHQPVGPDLAFSPLLYIQMTRFSCGGLALGLSWAHIMGDPFSLSHFFNLWAQAFAGGKIYCPKTSVTERDFQNPTSTFKKPDSVKQVDLVGDLWVAPNNSKMTTFSFNLTVNDLKTHFPVNGDGEFEILTGIIWKCVATVRGESAPVTITVIRSDPKKLKPRAVRNGQMISSIHVDFSVAEASLEEIVKSIGEAKDERVVIDEIVDDVSDFIVYGANLTFVDMSEVDFYEAKVMGKSPESVYCNVQGIGDDGAVVVLPGVVEEERVVTVTLPVDEIEKVKWEMKKCGLITPLV

SEQ ID NO: 186 - DNA, 1287 bp, Arabidopsis thaliana
atgggtcgatctcaagaacagggacagggacagggtccggttcacagcattcggctatctaccgtaggtgcgacccggccgacagagacgggtacgacccacgaaccaaccggtttagacctagccatgaagctccactacctcaaggcggcatacatttactcagccgagacagcacgtgacttaaccgtgagacacctgaaggaggccatgttcatgttgttcgaccagatcgcttggaccacaggcaggttctcaaggagagactcgggccgtccgtacatcaagtgcaacgactgcggcacacgtttcgtggaaggtcaatgcaatctcactgtggaggagtggctcagtaaaccggaccggtcagttgatgagtttctggtttatcatcatcctattggaccggaattgacgttctctcctttgatctacgttcagatgacccggtttaaatgcggaggattagggttgggcctaagctgggccaatataataggagacgcattctctctgttctatgccttcaacttatgggctaaggccattaccggagaaaagatttatgccccaacaacaccctctataggagagagaaggttccaaagcccaaacccgacggttaaagatccggtttcaattaaacgggtcgaacccgttggagatctctgggtcactccaaacgacaagaaattggcgaattactgtttcaatctctcagtcgccgatcagatatcaccacattttccggcgaagggagatgactcgattccggtgttcgagattctcgccggaatcatatggaaatgcatagctaaagttagggtagagccaaagcctgtaacggttacgatcattaaaaaagatccgaacgatctgaaacttaatgcgattcgaaacagtcaggtgatcagctcagtgagcgtggattttccggtggcggaagcgacggtggaggaattagtgaaagctatgggggaagcgaaggatgagagatgtggaattgaggagatcggagagagttgcgatgggaatttggattttgttgtttatggagcgaaattgacgtttctggatctgactggtgaggatttgtatgaggcgaaagtgatggggaagtcgccggagtcggtttattgtaatgtggaggggataggggaggagggattggtggttgtttacgcggcggcgaaatcggaggagagggttgtgacggttacgttgccggaggaagagatggagagggtaaaattggaatttaagaagtttggtttgatcgcgccatga

SEQ ID NO: 187 - protein, 428 aa, Arabidopsis thaliana
MGRSQEQGQGQGPVHSIRLSTVGATRPTETGTTHEPTGLDLAMKLHYLKAAYIYSAETARDLTVRHLKEAMFMLFDQIAWTTGRFSRRDSGRPYIKCNDCGTRFVEGQCNLTVEEWLSKPDRSVDEFLVYHHPIGPELTFSPLIYVQMTRFKCGGLGLGLSWANIIGDAFSLFYAFNLWAKAITGEKIYAPTTPSIGERRFQSPNPTVKDPVSIKRVEPVGDLWVTPNDKKLANYCFNLSVADQISPHFPAKGDDSIPVFEILAGIIWKCIAKVRVEPKPVTVTIIKKDPNDLKLNAIRNSQVISSVSVDFPVAEATVEELVKAMGEAKDERCGIEEIGESCDGNLDFVVYGAKLTFLDLTGEDLYEAKVMGKSPESVYCNVEGIGEEGLVVVYAAAKSEERVVTVTLPEEEMERVKLEFKKFGLIAP

SEQ ID NO: 188 - DNA, 1305 bp, Glycine max
atggtcttagaagagagtgtagtgcatgatgtgaggctatcctcagttgggccgggccgggccaccgggtcggacgtattccacaacccgggtggcttggacttggccatgaagcttcactaccttagagtggtgtacttctttgatagtgaggctgcacaagacctaaccatcatgaaaattaaggatggcatgttcactttgttcaaccattacttcatcacctgtggccggttccggcgatcggattccggtcgacccttaatcaagtgcaatgattgtggagcaaggttcattgaggccaagtgcaacaaaaccctagatgagtggctagccatgaaggattggcccttgtacaagttgctcgtctctcaccaagtcattggcccagaactatctttttctcctcctgttttgttccaggtgactaaatttaagtgcggcggaatttcattgggtcttagttgggcccacgtattgggggatcctctttcggcttcagaattcattaactcttggggtctaatattgaaaaatatgggcctaaaaatgctttttaacatcccaagatccatcccaacacccggacagcccggacctgaaaaggatccagtttcagcaaaacggatcgacccggtgggagatcattggattccagccaacaacaaaaaaatggagacattctccttccacctaactagctcccagttgaactacttgcaagcacaaatttggggtacaagtcttgaccaaacccctccttttgaatcactatgtgccatgatttggcgttgcatggcccgaattcgaccaggatccgaacccaaaaccgtaactgtgtgtagaagcaacccctataagaggggcaatcatatcattggtaacaaccaagtgatatgcaaggttgatgctgcaagtgaatcctcaattcttgacactgatttgacagttttagctagcatgcttgtggatcaaggtgtggatgagaggaagcaaattgaggaagcagttgagagagaccaaggtgtgagtgatttcttcgtctatggtgtcaacttgacatttctagacttacaagaaaccaatgtgtatgacttgcaattgaagggacacacaccaaagtttgtttactacacccttcaaggtgttggagatgaaggggttgttttggtgtatccattgcccaaaggttctatggagaatggtgttgatgggaagtttctgaccatgatttttccggaggatgaaatggtgaagcttaaatctgagctcaagataattggtcttttgcttgagaataattaa

SEQ ID NO: 189 - protein, 434 aa, Glycine max
MVLEESVVHDVRLSSVGPGRATGSDVFHNPGGLDLAMKLHYLRVVYFFDSEAAQDLTIMKIKDGMFTLFNHYFITCGRFRRSDSGRPLIKCNDCGARFIEAKCNKTLDEWLAMKDWPLYKLLVSHQVIGPELSFSPPVLFQVTKFKCGGISLGLSWAHVLGDPLSASEFINSWGLILKNMGLKMLFNIPRSIPTPGQPGPEKDPVSAKRIDPVGDHWIPANNKKMETFSFHLTSSQLNYLQAQIWGTSLDQTPPFESLCAMIWRCMARIRPGSEPKTVTVCRSNPYKRGNHIIGNNQVICKVDAASESSILDTDLTVLASMLVDQGVDERKQIEEAVERDQGVSDFFVYGVNLTFLDLQETNVYDLQLKGHTPKFVYYTLQGVGDEGVVLVYPLPKGSMENGVDGKFLTMIFPEDEMVKLKSELKIIGLLLENN

SEQ ID NO: 190 - DNA, 1179 bp, Populus trichocarpa
atggtttcttgcaaggaggatcaaaatttggtctatgacattaaactatcatctgctggaccgggtcgtattactggttcggacgtgattcacgagcccaatggcatggacttggccatgaagcttccctatctaaaaggtgtctacttttttaacagccaagcatgccaaggattgaccatcatgcaaattaagggaagcatgttttactggcttaacgactactatacagtttgtggccgcttccagcgaacggaggctggacggccatacatgaaatgtaatgactgtggtgtgaggattgtagaggctcggtgcagcaagacagtcgatgaatggctagaaacaagggattgttctcttgacaatcttcttatttaccattcacctattggtcctgaattatttttctctccttcgctttacatgcaggtaaccaagttcaaatgtggaggaatgtccttgggcattagctgggcccatataattggagatgtgtattcagcttcggagtgcctcaactcctggggccaattcctggctggtcttaagtcgtatgggcctttgaagctcacaaaatcacccactgggcttgaagattccaagagcccatctgtgggtacccaggaacccgtttctctgaaacaggtcgacccggttggtgacctctgggtaactgccaataactgcaaaatggaaactttttcattccatttatctgcttcgcaagtatctcaattacactcaagaatttggggtccgagtggaattgccaagatcccattttttgagtcgctgtgtgctataatgtggcaatgcatagccaaagctaaagatgggcttgagcctaaagttgtcaccctctgcaagaaagatcccaacaaccctaaagatgggattttgagcaacagtcaaattataagttcagtcaaggcagattcctcagttgtggacgcagatttgaaagaactggccacgttgctggttgatcaagccacagaggagaatagccaaattgaagagaagagactaatttttatggactggaatggaatggacataaaccagaagctgtgcactatagcatccaaggtgttggagatgaaggagctgttatggtacttccatggccaaaagattcaggcacggatggcaacattggaaggatcgtggtggtaa

SEQ ID NO: 191 - protein, 392 aa, Populus trichocarpa
MVSCKEDQNLVYDIKLSSAGPGRITGSDVIHEPNGMDLAMKLPYLKGVYFFNSQACQGLTIMQIKGSMFYWLNDYYTVCGRFQRTEAGRPYMKCNDCGVRIVEARCSKTVDEWLETRDCSLDNLLIYHSPIGPELFFSPSLYMQVTKFKCGGMSLGISWAHIIGDVYSASECLNSWGQFLAGLKSYGPLKLTKSPTGLEDSKSPSVGTQEPVSLKQVDPVGDLWVTANNCKMETFSFHLSASQVSQLHSRIWGPSGIAKIPFFESLCAIMWQCIAKAKDGLEPKVVTLCKKDPNNPKDGILSNSQIISSVKADSSVVDADLKELATLLVDQATEENSQIEEKRLIFMDWNGMDINQKLCTIASKVLEMKELLWYFHGQKIQARMATLEGSWW

SEQ ID NO: 192 - DNA, 1281 bp, Ocimum basilicum
atggaaggaggagggatccatagcgtgagagtaacgacagtggggccggggaaacagacgggactgaacgcggagttcgatccgggaaacttggggttggcgatgaagcttcattacctgagaggcgtctactatttcaggagtgaagcatttgaggggttgacgacgttgaacgtgaaggagccgctgttcagctggctcaaccagttccccatgccgtgcggccgattccgccgctccccatcaggccgccccttcataaaatgcaatgactgtggcgtcaggttcattcatgccaaatgcgaccacactcttgatcactggttgcacatcaaggattcccttcttgaggcgctcttgtgccaaaaccatgttcttggcccccaacttccttattcgcctctcctttacttgcagatgactgtattcaaatgtggaggggtgggtatgggcttaagctgggcccatgttgttggagacgcattttcagccgcaaaaatcatgaacatgttgggccgggtcatatcagggttcaaaccagaacgccccattgacctcacccaaaccctaaacgagcttcgcattccagactgcgtcccaaacattacggaggatccggtttccgtcagacgggtcgacccggtcggagactcttgggtatacgccactacctgcaaaatggaaacattctccttcaacgtgtctcccgcaaaactgagtcacctccgatccaaactcgctaaacacggtgtcgattccccatccttcgagtcactcgctgccgcgatttggcaatgtatcgccagaatcagggctgattcaagagtcgtcaacattttcagaaaaggtcatgaagcgagtagcaataattcgattttgggaaataaccaaattgttagcgtggtgagggctgcgtttgctgtagcggaggctaaccctagcgagctggcgtggatgttgaaaaatgaggcgttggacgagaccaaaatcatccaacaggctgtggagagagatggcggatcctcggatttcatcatcttcggtgttaatttgtcgttcgtgaatctggaggaagcaacattttacgacttggaatgtcgtcgggggcagaagccgatttcagttagttgcaaaattgatagtgtgggtgaaaaaggagtggttttggtgctgccgggcgacggcgataagagtggagggaggctggtgacggtgacgctgccggagaatgaggttgtgggagttaaatcggagctaaaaagggaaggactaatggcctga

SEQ ID NO: 193 - protein, 426 aa, Ocimum basilicum
MEGGGIHSVRVTTVGPGKQTGLNAEFDPGNLGLAMKLHYLRGVYYFRSEAFEGLTTLNVKEPLFSWLNQFPMPCGRFRRSPSGRPFIKCNDCGVRFIHAKCDHTLDHWLHIKDSLLEALLCQNHVLGPQLPYSPLLYLQMTVFKCGGVGMGLSWAHVVGDAFSAAKIMNMLGRVISGFKPERPIDLTQTLNELRIPDCVPNITEDPVSVRRVDPVGDSWVYATTCKMETFSFNVSPAKLSHLRSKLAKHGVDSPSFESLAAAIWQCIARIRADSRVVNIFRKGHEASSNNSILGNNQIVSVVRAAFAVAEANPSELAWMLKNEALDETKIIQQAVERDGGSSDFIIFGVNLSFVNLEEATFYDLECRRGQKPISVSCKIDSVGEKGVVLVLPGDGDKSGGRLVTVTLPENEVVGVKSELKREGLMA

SEQ ID NO: 194 - DNA, 1314 bp, Oryza sativa
atggtgctcgaggggcaggagacaccggcggcggcggcggtgcacgggcaccggctgtctacggtggtgccgagctcggtgacgggggaggccaactacgacctcgccgacgccgacctggcctacaagctgcactacctccgcggcgcgtactactaccccgcgggcgacgccgtgcgcgggatcaccatcaagtcgctcaaggaccccatgttcccctggctcgacgcctacttccccgtcgccggccgcatccgccgcgccgagggcgacgacgccgacgccgccgcggcgcgccgcccctacatcaagtgcaacgactgcggcgtccgcatcgtggaggccaggtgcgaccgcgccctcgacgactggctccgcgacgaatcccccgaccgcctccgccatctctgctacgacaaggtgctcggccccgagctcttcttctcgccgctcctctacatccaggtcacgagcttcaaatgcggtggcatggcgctcggcttcagctgggcgcacctcatcggcgacgtggcgtcggcgaccgcctgcttcaacacgtgggcgcagatactgagcggcaagaagcccgcgggcaccgtcctcgagccggcgaacaagccgctggaccgcgcgcccgccgcagccgccgccgcgccgccgcgctccgtcaagccggtcggccccatcgaggaccactggctcgtccccgccggccgcgccatggcgtggtactccttccgcgtcaccgagccggcgctcaagaagctgcaatccgcggcgggacgccatgcggcgggcacgttcgagctcgtctcggcgctcctatggcaggccgtggcgaagatcagggcggcggcgtccaaggaggtgaccacggtgaccgtggtgaggacggacatggccgccaggagcggcaagtcgctggcgaacgagcagagggtcgggtacgtggaggcggcctcgtcgccggcgaagaccgacgtcgccgagctggcggcgatgctggccggggacaaggtcgtcgacgagaccggcgcggtcgccgcgttcccgggcgacgtcgtcgtctacggcggcgccaacctgacgttcgtcgacatggagcaggtggcgccctacgagctggagctgaaggggcagcggcccgtccacgtggagtacggcctcgacggcgtcggcgaggagggcgccgtgctggtgcagccggacgccggcggccgcggccgcgtcgtcacggtggtgatccccagggacgaggtcgacagcctccgcgccgcgctcgggagcacgctcctgctgctgcaagacgcctga

SEQ ID NO: 195 - protein, 437 aa, Oryza sativa
MVLEGQETPAAAAVHGHRLSTVVPSSVTGEANYDLADADLAYKLHYLRGAYYYPAGDAVRGITIKSLKDPMFPWLDAYFPVAGRIRRAEGDDADAAAARRPYIKCNDCGVRIVEARCDRALDDWLRDESPDRLRHLCYDKVLGPELFFSPLLYIQVTSFKCGGMALGFSWAHLIGDVASATACFNTWAQILSGKKPAGTVLEPANKPLDRAPAAAAAAPPRSVKPVGPIEDHWLVPAGRAMAWYSFRVTEPALKKLQSAAGRHAAGTFELVSALLWQAVAKIRAAASKEVTTVTVVRTDMAARSGKSLANEQRVGYVEAASSPAKTDVAELAAMLAGDKVVDETGAVAAFPGDVVVYGGANLTFVDMEQVAPYELELKGQRPVHVEYGLDGVGEEGAVLVQPDAGGRGRVVTVVIPRDEVDSLRAALGSTLLLLQDA

SEQ ID NO: 196 - DNA, 1206 bp, Triticum aestivum
atggggtcggaggcagcggcggcggcggtgcacgggcaccaggtgtcgacggtggtgccgagctcggtgacggaggtgggcagctacgagctggcggacgcggacctggcgttccggctgcactacctacgcggggtgtactactactccgcgggggtcaccaccatggtgctcaaggagcccatgttcgcctggcttgacgcctactaccctttggccggccgtgtccgccgccacgccgacgaagccgacgatgcctcgcgccgcccatacgtcaagtgcaacgactgtggcatccgcatcgtagaggcccagtgcgaccgcgcgctcgacgacttgctccgcgacgacgccgtcgatcgcgtgaagcagctctgctaccaccacgtgctcggcccggagctctcgttctccccgctgctcttcgtccaggtcaccaacttcaaatgtggagcgatggcgctggggttcagctgggcgcacctcatgggcgacgtggcgtcggcgacgacctgcttcaaccgctgggcacagatactcggcggcaagaagccagtcgccgtcaccatgagccccatcaacgagccgcgagagagaaaccgtacgccttccgcggtcgcgccgcgctcggtcaagccggtcggaccccatccaagaccactggctggtccccgccggcgtcgacatgacgtgctactccttccacgttaccgaaacgatgctcgagaggctgcggcagcaggagccagcggctcccggcggcgtcttcgagctcatatcggcgctcctatggcagacggtggccaagatcagggccaccgacgaggtgaagacggtgacggtggtgaagaccgacatgtccgcctggagcggttactccctggccaacgagcaaaatgtcgggtacgtggaggcgggctctgcgccggccaacacggacgtgtccgagctggctgcgctgctggccaaggatctggtcgacgagaccgccacggtggtccgcttcccgggggacgtggtcatctacggcgccaatctaacgttcgtggacatggagcaggtcgacctgtacgggctggagatcatggggcagaggcccgcacacgtggagtacggcatggacggcgtcggtcaggggggtgccgtgctggtgcagtccgacgccagcgggcgtggccgcgtcatcatggtggtgctccccaatga

SEQ ID NO: 197 - protein, 401 aa, Triticum aestivum
MGSEAAAAAVHGHQVSTVVPSSVTEVGSYELADADLAFRLHYLRGVYYYSAGVTTMVLKEPMFAWLDAYYPLAGRVRRHADEADDASRRPYVKCNDCGIRIVEAQCDRALDDLLRDDAVDRVKQLCYHHVLGPELSFSPLLFVQVTNFKCGAMALGFSWAHLMGDVASATTCFNRWAQILGGKKPVAVTMSPINEPRERNRTPSAVAPRSVKPVGPHPRPLAGPRRRRHDVLLLPRYRNDAREAAAAGASGSRRRLRAHIGAPMADGGQDQGHRRGEDGDGGEDRHVRLERLLPGQRAKCRVRGGGLCAGQHGRVRAGCAAGQGSGRRDRHGGPLPGGRGHLRRQSNVRGHGAGRPVRAGDHGAEARTRGVRHGRRRSGGCRAGAVRRQRAWPRHHGGAPQ

SEQ ID NO: 198 - DNA, 1383 bp, Arabidopsis thaliana
atgtttgctaaagagaagacaataatggaggaggaccgcgtgagattcatatgcaaaagaaccgtggtgagcactagatcgattgaaccagggcgattataccagttatcagtattggaccacgtcatggaaccaaaccacattcgtctagtctactattaccggtgttccaagactagagaaccgggagaaatcacaaaaaaattaagggagtcattagcatacacactcaattgttatccgattgtaaccgggagactggttaaagaagttgatggtatggaagagaataaggatttaagccaacgatggatggtaaagagcaacgacgccggcgtgaggatggtggaggccagagcaaccgggtcagttaaggaatggcttaggagtgtaaatagagaggaagaactcaagcttgttcattgggaagacatgtatcatcttcaatattattggtctaccttctgtgttcaggtaactgagtttgaaagtggtgggttagctattggattgagttgtagccatctcttagccgatccagtttgtgcaatgatgtttattcgagcttgggcagatttaactttgtctcggtccatgatggctccaccactattccacccgttgccgcctcgccggttttccaaccaaagactaatctctaacaaccaactgcttagccattacatcaaatcttgctctctaacggcttcaccgtcaaacatgaccgaggaccatatggtcaccgttacttttctgttcccggatccgctggtcagagccggcgagaatgagccaaggatttcgacatttgagattttggctggactcttttgggtctgtgtgagtcgagccaaaggaaaaagaaacgagctcatggacatgtccttgtgcttagacgttaggaaattgttgcgtttagaccaaagttattttggtaattgcatggtttatcacaaggttccctactccaaaccggttaaaaccaaagataaactcttattccacgctgttcaagagattgagagcataaccaagagactagactacgacacggtcatggacttgattgagtggttgagtagcaataacggtgcgatatcaaatggttcggatctcgtgtgtactaatttagaaaacatgtctcattcacgtccgatgatgttcgaggaggatttggctctgagccacgtatcttgctatgtagaagggcctgtagctggaggtggacaggtcatagtgcttccctcaccgcccggtaaggaaccaatgagccgagtggttatggtcagtcttcctcaaagagtgatggttaaggttatagaagacgagcttcttttaagcttttctccggtcgtaattatggaagatacaaagcaattataa

SEQ ID NO: 199 - protein, 460 aa, Arabidopsis thaliana
MFAKEKTIMEEDRVRFICKRTVVSTRSIEPGRLYQLSVLDHVMEPNHIRLVYYYRCSKTREPGEITKKLRESLAYTLNCYPIVTGRLVKEVDGMEENKDLSQRWMVKSNDAGVRMVEARATGSVKEWLRSVNREEELKLVHWEDMYHLQYYWSTFCVQVTEFESGGLAIGLSCSHLLADPVCAMMFIRAWADLTLSRSMMAPPLFHPLPPRRFSNQRLISNNQLLSHYIKSCSLTASPSNMTEDHMVTVTFLFPDPLVRAGENEPRISTFEILAGLFWVCVSRAKGKRNELMDMSLCLDVRKLLRLDQSYFGNCMVYHKVPYSKPVKTKDKLLFHAVQEIESITKRLDYDTVMDLIEWLSSNNGAISNGSDLVCTNLENMSHSRPMMFEEDLALSHVSCYVEGPVAGGGQVIVLPSPPGKEPMSRVVMVSLPQRVMVKVIEDELLLSFSPVVIMEDTKQL

SEQ ID NO: 200 - DNA, 1323 bp, Glycine max
atggccttggaagtaactcatatatgcaaaagaactgtggtgagcaccaaggcagtggagccaggaaagtacttccccttgtctgttttggatcgctacatggagaacaaccacattaggatggtgtactattaccaaacctcaagagaagtggaacttggaaaagtgaccaagaagttgagagagaccttgtcagagatgcttacccattttcccatagtgagtggaaggttggtaagagatgatgagacagggcattggaagatcaagtgcaatgatgctggagttagagtggtggaggccaaagccaaagggagtgtaggagggtggctagctaaccttgatagggaaaaggaactccaacttgtgcattgggaggacatgtttcacaagccctattattggtccaccttttatgtccagctaactgaattcgaagaaggtggattagcaattggcctaagctgctttcatctcttggtagattccacttgtgcaacattattcatgaaagcctgggctgacatttcaatggtaaacaaaatgattactcctccattattccatcatttacctcctcgaaggccaccaaatagaaaccccaatcatcacctccacatggagttaattcatcactacaaatccctaattgaaaaacccaattctacaaaagaaacaatgtacactacaatttcaatgggcttctcaaaccccatggttcaggcctgcatgtccatggcccaacctaatggcccaataccgccctttgaggctttagcagcattattttgggtctctttgagcaaagtgaagggtctgagaaataggcttgttgacatgtccatatgtttggacatgagaaaagtgttgggcctagattgtacattctttgggaactgcatggtgtataataaggtcaatgtagaagggaacaattacaaatttccgcaagttgttagggcaataagtgatgttgtggctaaaatggacactgaggcaattatcaatttgaccgagtggctagaaaataatgatgtgaattcacctaccatgatgaacaatcataatttggtttgtactagtttagagggtatggacccttatttaaccgtgtttccagatttgttcaaacccatccatgtttcttattacatagaaccagttgtgggagaaggacaagttttgattctgcctggtcttccagaggagggtcctttaagtagggtggccatggtgacccttaggaaagaagaagcaattaagctttgtgaagatgatcttatttcacaattctctcccactatattgatgaaatgtgaatga

SEQ ID NO: 201 - protein, 440 aa, Glycine max
MALEVTHICKRTVVSTKAVEPGKYFPLSVLDRYMENNHIRMVYYYQTSREVELGKVTKKLRETLSEMLTHFPIVSGRLVRDDETGHWKIKCNDAGVRVVEAKAKGSVGGWLANLDREKELQLVHWEDMFHKPYYWSTFYVQLTEFEEGGLAIGLSCFHLLVDSTCATLFMKAWADISMVNKMITPPLFHHLPPRRPPNRNPNHHLHMELIHHYKSLIEKPNSTKETMYTTISMGFSNPMVQACMSMAQPNGPIPPFEALAALFWVSLSKVKGLRNRLVDMSICLDMRKVLGLDCTFFGNCMVYNKVNVEGNNYKFPQVVRAISDVVAKMDTEAIINLTEWLENNDVNSPTMMNNHNLVCTSLEGMDPYLTVFPDLFKPIHVSYYIEPVVGEGQVLILPGLPEEGPLSRVAMVTLRKEEAIKLCEDDLISQFSPTILMKCE

SEQ ID NO: 202 - DNA, 1404 bp, Pinus taeda
atgggtgaggaagcgcctgcaagaacatccaagaagatgggtaaggagaacgttcagattcactccaagctgacggtggtgcccagcaaggcggttgcaccaggcaaattttatcctctctctgttctcgatcacatgatgcagctccataatgtcggccttgtctattactaccgagaagctctcactacggcgacctccacagatgttgtcatggacctgaaggtctctctttcccgagttctctcaagctatccggcggtgtgcggaaggttgcagcgccggaacgatggaaattgggaaatcagatgtagtgatgcaggcgtccgggttttggaggccaaagttgacatgactcttgaaaaatggtttgaagttgcagatagagactctgagctcaagctttgctactgggaaactgtgggccaagatccttatatctcttctcttttttgtgttcagttcactgaatttgaaggagggggactggccattgggttgagctgcggtcacatgctagccgatcccagctgtgcaactctgatcatgaaagcctggggagaaacccatcgtcgggcacaggttctgcatccgcccttcttccatccaccaggcttgaaggcaaggccaaataaatgcgaggtaacgactgcaaccaagtattacgaatctaccttcaagagggagctggctactagttgtgatcaaggggatgcaggatacaaaacaactattttcaaattcagtgatgagatggtgcaacaatgcgtttccgaggttcagggaggagatcacaagtatgagccggtgactccatttcaggctctgtctgctctgttctggattgcttgcaccaaagccaaaggaataactggtgcagaagaatcgaaactgtcagtgtgttcagagtttcggaagataattatagctcctctgcctcatggcttctttggaaatgcattgcatttctcagaggtttctagcagtgcaggagatcttgtgggtaatgacttgtcttaccctgcaaagcttatacatgatgatatatttcggctggacaaggatgaattgagatcagtggtggagtggctggacaaacagaagaacagtgacgggcagctgccacctccgttctacctctatggtcccaatctcacagctgttaatggcgaggagttcttcacttatgatgctgtttttgaaaaggagctgaaacccctccatgtttcttactatgtggagccggtgcatggggagggccttattatggtgcttccttctgcagaagctggctccagcagaacagtcatggtaaccctccctgctacccaggcgagccaactttccatggatcctgcccttctgcgattcagtcctaccatttggatgaataatgtagcctag

SEQ ID NO: 203 - protein, 467 aa, Pinus taeda
MGEEAPARTSKKMGKENVQIHSKLTVVPSKAVAPGKFYPLSVLDHMMQLHNVGLVYYYREALTTATSTDVVMDLKVSLSRVLSSYPAVCGRLQRRNDGNWEIRCSDAGVRVLEAKVDMTLEKWFEVADRDSELKLCYWETVGQDPYISSLFCVQFTEFEGGGLAIGLSCGHMLADPSCATLIMKAWGETHRRAQVLHPPFFHPPGLKARPNKCEVTTATKYYESTFKRELATSCDQGDAGYKTTIFKFSDEMVQQCVSEVQGGDHKYEPVTPFQALSALFWIACTKAKGITGAEESKLSVCSEFRKIIIAPLPHGFFGNALHFSEVSSSAGDLVGNDLSYPAKLIHDDIFRLDKDELRSVVEWLDKQKNSDGQLPPPFYLYGPNLTAVNGEEFFTYDAVFEKELKPLHVSYYVEPVHGEGLIMVLPSAEAGSSRTVMVTLPATQASQLSMDPALLRFSPTIWMNNVA

SEQ ID NO: 204 - DNA, 1338 bp, Glycine max
atgtccaactcgagggtagctgtgaactcaaaactaacggttgtgtcgagcagacccgttagtgcttcgggtaagggtaaggctcatgcgctatccgcgcttgacagtgccatgggttcacacacagtgcatgttatatactactacaagaacgaggagaagtggtttgagtcgtttgatttgttggaccctttgagggaatcgttgtctgaggttctgactctctaccctactgtgacgggtcggttgggaaaaagaggagtggatggtgggtgggaagtgaagtgtaatgatgcgggcgttagggtcataaaagccagcgtggatgctacacttgatcaatggctcaaatctgcctctggctccgaagagaaccttctggttgcttgggatcatatgcctgatgatcctaccacatggtctccctttcgaattcaggtaaacagattcgaaggaggaggtgttgcaataggaataagttgtagtcacatggtggcagatctaactttcttagcatcatttttcaaatcatggacggaagttcaccgccacttggccattacccaccctcccttcgtcgctccacttccaaatcacgccgatgatgatgcagagtctctccctcgccatgcaaaaacacactctccgagaaacatggctacagccaccttcaagttttcaagttcaatcatcaaccgatgcctctccaaagtccatggcacgtgccccaacgccaccccatttgacttcctcgccgctctgttttggaatcgcatcgctcgggtcaaacctccaaaaaatcaccaccaaacacactgtctttgcatttgcaccgactttaggaatctcataaaagcgtccctccctattgggtacttcggaaatgccttgcacttttcaatgctctcgcagaaagtggaagacatgcaattaggaggcatagtcagtgcagtgcatagccacctgaaagggctttcagaggaagaaatatggtctacgaataatgaagggaattattattgcatgtatgggactgagttaacttgtgtttgcatggagcacttggtgtttgaggaagaaaatgagtcgttgctatatgctgcaatgtttgggaataacgagaagccaattcaagtttcatgtcgcgtggggaatgtggattatggtgaaggtttgatcacggtgatgccttctgaagaaggaggactttcgagaacagtgatggtgatgcttcctgaggaagaactcgctgaactaagcaaagatgaagcaatattggagttggagccagcgatgcttcttgctggttctgtggtcagtggtggaccattgacttaa

SEQ ID NO: 205 - protein, 445 aa, Glycine max
MSNSRVAVNSKLTVVSSRPVSASGKGKAHALSALDSAMGSHTVHVIYYYKNEEKWFESFDLLDPLRESLSEVLTLYPTVTGRLGKRGVDGGWEVKCNDAGVRVIKASVDATLDQWLKSASGSEENLLVAWDHMPDDPTTWSPFRIQVNRFEGGGVAIGISCSHMVADLTFLASFFKSWTEVHRHLAITHPPFVAPLPNHADDDAESLPRHAKTHSPRNMATATFKFSSSIINRCLSKVHGTCPNATPFDFLAALFWNRIARVKPPKNHHQTHCLCICTDFRNLIKASLPIGYFGNALHFSMLSQKVEDMQLGGIVSAVHSHLKGLSEEEIWSTNNEGNYYCMYGTELTCVCMEHLVFEEENESLLYAAMFGNNEKPIQVSCRVGNVDYGEGLITVMPSEEGGLSRTVMVMLPEEELAELSKDEAILELEPAMLLAGSVVSGGPLT

SEQ ID NO: 206 - DNA, 1371 bp, Zea mays
atgccttcggcggcgatgacggtagcggcgggtctggcgaccgggccgggcagccgtgtgactcggttcgccaagtcgacggcggcgtcggtgacgcccgtgaggccgggcaagacgcacgcgctgtcgcccctggacaacgccatggagcggcacacggtgcacgtggtggtctacctccgcgccgcgccgggcctggacagggagcagctcaaggagtcgctctccgaggtgctgtcgctctacccggccatgaccggccggctcacgcgcggcgaaggcagcgcggacgccgaacctgcgcaccggggttgggtcgtgaagtgcaacgacgccggcgtgcgcatggtggatgccagggcggccgtcacgctcgacgagtggctcgccacggcgaccggcgacgaggagatggacctcctctattacgagcccatgggggccgagccttacatctggtctccgttctacgtccagctgacagagttcaccgacaagtcgtacgcgctggggctgagctgcatccacatccacaacgaccccaccgctgccgctctcttcttccacgcctgggcagccgcccaccgccggaccaccagcacgtacccgcccttccttcacccgccggcgttggcggtctccccgacctcgccgccccctgcaccgcctctgctcgccgagaaagccagcgccgcctcccccaccagcacagatgccgccgccgccatgtcttccgccacgttccacttcccggcctccgcggtgcgcgcgctgctctcctccctggagccgggcaccaccccgttcgcggcgctcgccgcgctcttctggctccggatcaccggcgccgccgacggggagcgagagctcacactggcgctggacttccgcaagcggatgtacgcgccgctgccgtgggggtactacggcagctccgtccacttcacgcgcgcgcgcgccgacctcgcgtccggcctgcccgccgtggccgcggcgctggaccgccacgttgccggcgtgccggaggaggagctgtggcgcgccctggagtggctccacacgcggcagcagcaggaaaacgcgccgttccagatgtatgggccggagctgacgtgcgcggcgctggaccacgtgcccatgtacggcgcggagttcgaggccggggcttttccggcgcgcgtgtcgtgccgcgtgggcggggccaccggcgaggggctggtgctcgtcctgcccgcgcccgagggcggcgaggcgcgggacgtggtggtgacgctgcccgcgggggcgacggccagggtctgccgcgacgccgaggtgctccggcacggtgccgaagttgtgttcggggcgaaggccgaaaaggaggagtag

SEQ ID NO: 207 - protein, 456 aa, Zea mays
MPSAAMTVAAGLATGPGSRVTRFAKSTAASVTPVRPGKTHALSPLDNAMERHTVHVVVYLRAAPGLDREQLKESLSEVLSLYPAMTGRLTRGEGSADAEPAHRGWVVKCNDAGVRMVDARAAVTLDEWLATATGDEEMDLLYYEPMGAEPYIWSPFYVQLTEFTDKSYALGLSCIHIHNDPTAAALFFHAWAAAHRRTTSTYPPFLHPPALAVSPTSPPPAPPLLAEKASAASPTSTDAAAAMSSATFHFPASAVRALLSSLEPGTTPFAALAALFWLRITGAADGERELTLALDFRKRMYAPLPWGYYGSSVHFTRARADLASGLPAVAAALDRHVAGVPEEELWRALEWLHTRQQQENAPFQMYGPELTCAALDHVPMYGAEFEAGAFPARVSCRVGGATGEGLVLVLPAPEGGEARDVVVTLPAGATARVCRDAEVLRHGAEVVFGAKAEKEE

SEQ ID NO: 208 - DNA, 1044 bp, Populus trichocarpa
atggcaatgtcccagattagtagtgagtttgtgcataaagtacaaattgaaggtgtgcaaacagtggcaccctccaaggtgactgatccaagagaaacgtgcctagtgtcagtgaaggaccctgttagttcagatattttccaggggtgcctgagcatagtcctctgctacaacaaggccgtggaggaagattctggttggcttgttgcgggatggattaaggagtccctggggagagcattgcaggaccaaccgatgctcagtggacgactacggagagttgaagatggcaatggagaactagagatggtgtcaaacgataccggagttagacttgttgaggcaaagattacaatgactttgcaagagtttcttggtttggaagaaaacgaaaaagcagaggccgaactcgtctcttggatggatattgatgaacaaaatccccaattctctccgctactctatgttcaggtcaccaacttccagtgtggtgggtactcaattgggattagttctagccttctcttggcagaccatttaatcatggacaacttcctcccgaggtggtcaggtattcaaaagaaattactgctcaacaacaatgcactcgaaaagcccatattctacctccccaatctcagaaacaccagtttatctcctagtaacaccacgaggtccacacctagcaaacagagcgatagcgaaattgaaggtgtgcagaatgagttatgcaagagagccgtatcacattgcatccaggaggcagagcacaaactaggcagtgaaatgtcatcagagttttctttgtttgtgaaagaatcacctaaggttaaaagggtcgagaattgcaagaaaaacgaacttgttaagcctaatctgaactttaggtgtcaagtgatcaccttggatgatttagggatcaaagaattagctttccacgatggcaatgagcctactcacgtttcttgctggattggatcggcggttgcaatggcgattccatcttctactgagaatacttcagaccacatcaaaacgatctga

SEQ ID NO: 209 - protein, 347 aa, Populus trichocarpa
MAMSQISSEFVHKVQIEGVQTVAPSKVTDPRETCLVSVKDPVSSDIFQGCLSIVLCYNKAVEEDSGWLVAGWIKESLGRALQDQPMLSGRLRRVEDGNGELEMVSNDTGVRLVEAKITMTLQEFLGLEENEKAEAELVSWMDIDEQNPQFSPLLYVQVTNFQCGGYSIGISSSLLLADHLIMDNFLPRWSGIQKKLLLNNNALEKPIFYLPNLRNTSLSPSNTTRSTPSKQSDSEIEGVQNELCKRAVSHCIQEAEHKLGSEMSSEFSLFVKESPKVKRVENCKKNELVKPNLNFRCQVITLDDLGIKELAFHDGNEPTHVSCWIGSAVAMAIPSSTENTSDHIKTI

SEQ ID NO: 210 - DNA, 1281 bp, Zea mays
atggtgttcgagcagcatgaggaggaggcggtggcgccgggcgcggtgcacgggcaccggctctccacggtggtgccgagctcggtgacgggggaggtggactacgcgctggcggacgcggacctggccttcaagctgcactacctgcgcggggtgtactactaccggtccggggacggcctcgccaccaaggtgctcaaggaccccatgttaccgtggctggacgaccacttccccgtggccggccgcgtccgccgcgccgagacggagggggacggcgcgccgcgccggccctacatcaagtgcaacgactgcggcgtgcgcatcgtggaggccaggtgcgaccgcgacatggccgagtggatccgcgacgccgcgcccggcaggatcaggcagctctgctacgacaaggtgctcggtcccgagctcttcttctcgccgctgctctacgtccagatcacaaacttcaaatgcggtgggctggcgctggggttcagctgggcgcacctcatcggcgacatcccgtcggccgccacctgtttcaacaagtgggcgcagatcctgagcggcaagaagccggaagccaccgtcctcaccccgccgaaccagccgctgcagggccagtcccccgcggcgccgcgctccgtcaagcaggtggggcccatcgaggacctgtggctggtccccgcgggccgcgacatggcgtgctactccttccacgtcagcgacgcggtgctcaagaagctccaccagcagcagaatgggcgccaggacgcggccgctggcaccttcgagctcgtgtcggcgctggtgtggcaggcggtggccaagatcaggggcgacgtggacaccgtgaccgtggtcagggccgacgccgccggccggagcggcaagtcgctggccaacgagatgaaggtcgggtacgtggagtcggcggggtcgtcgccggcgaagacggacctcgcggagctggcggcgctgctggccaagaacctggtcgacgagaccgccgcggtggcggcgttccagggggacgtgctcgtgtacggcggcgccaacctgacgctcgtggacatggagcaggtggacctgtacgggctcgagatcaaggggcagcgcccggtccacgtggagtacggcatggacggcgtcggcgacgagggcgcggtgctggtgcagcccgacgccgacgggcgcggccgcctcgtcacggcggttttgcccggcgacgagatcgacagcctccgcgcagcgctcggtagcgcgctgcaggtcgcctga

SEQ ID NO: 211 - protein, 426 aa, Zea mays
MVFEQHEEEAVAPGAVHGHRLSTVVPSSVTGEVDYALADADLAFKLHYLRGVYYYRSGDGLATKVLKDPMLPWLDDHFPVAGRVRRAETEGDGAPRRPYIKCNDCGVRIVEARCDRDMAEWIRDAAPGRIRQLCYDKVLGPELFFSPLLYVQITNFKCGGLALGFSWAHLIGDIPSAATCFNKWAQILSGKKPEATVLTPPNQPLQGQSPAAPRSVKQVGPIEDLWLVPAGRDMACYSFHVSDAVLKKLHQQQNGRQDAAAGTFELVSALVWQAVAKIRGDVDTVTVVRADAAGRSGKSLANEMKVGYVESAGSSPAKTDLAELAALLAKNLVDETAAVAAFQGDVLVYGGANLTLVDMEQVDLYGLEIKGQRPVHVEYGMDGVGDEGAVLVQPDADGRGRLVTAVLPGDEIDSLRAALGSALQVA

SEQ ID NO: 212 - DNA, 1329 bp, Arabidopsis thaliana
atgcaagaactgccggattgtttgtacgaggaaaaccaaccaaccttaataactcctttatctcccacaccaaatcactctctctacctttcaaacctcgacgaccatcattttctcagattctctatcaagtacctttaccttttccaaaaatctatatcccctctcaccctgaaagattcgctctctagggttctagttgattactaccctttcgcgggtcggataagagtctccgatgaagggagcaagctcgaggtagactgtaatggagaaggcgcagttttcgcagaagctttcatggatataacttgtcaagattttgttcaactttctcccaaaccaaacaagtcttggaggaagctcttgttcaaggttcaagctcagagtttcttggatattcctcctcttgtcatacaggtgacgtatctccgttgtgggggtatgatcctctgcaccgcgatcaatcattgcctctgcgacggcattggcacatcgcagttcctacatgcatgggcccatgcgaccactagccaagctcatcttccgacccgaccattccactcccgtcacgtattagatccgcgaaaccctccacgtgtcacacactcacatcccggtttcacccgaaccaccaccgtagacaaaagctccaccttcgacatttccaagtatttacagtcccaaccattggctcctgccaccttaaccttcaaccaatctcatctcctacgcttaaagaaaacctgcgctccttcgctaaaatgcaccacgttcgaggcactagcggctaacacttggcgctcgtgggctcaatctctagatttaccaatgaccatgctggtcaaactcttattctcagtcaatatgagaaaacgactaactccagaacttccccaagggtattacggtaatggattcgtactagcttgcgccgagagcaaggtacaagacctagtcaatggtaatatttaccacgctgtaaaatcgatacaagaggcaaaatcaagaattaccgacgaatatgtaagatcaacgatagatttactggaggataaaacggtgaaaacggacgtctcgtgcagtttggtcatttcacaatgggcgaaattgggattagaggagttggacttgggaggaggaaagccaatgtatatgggtcctttgacgagtgatatctactgtttatttttacccgtggcgagcgataatgatgccatcagagttcaaatgtccctgccggaggaagttgtgaagagactagagtattgcatggttaagtttttagacggaaaagataacgaagatgagaattctcgtgcatgctaa

SEQ ID NO: 213 - protein, 442 aa, Arabidopsis thaliana
MQELPDCLYEENQPTLITPLSPTPNHSLYLSNLDDHHFLRFSIKYLYLFQKSISPLTLKDSLSRVLVDYYPFAGRIRVSDEGSKLEVDCNGEGAVFAEAFMDITCQDFVQLSPKPNKSWRKLLFKVQAQSFLDIPPLVIQVTYLRCGGMILCTAINHCLCDGIGTSQFLHAWAHATTSQAHLPTRPFHSRHVLDPRNPPRVTHSHPGFTRTTTVDKSSTFDISKYLQSQPLAPATLTFNQSHLLRLKKTCAPSLKCTTFEALAANTWRSWAQSLDLPMTMLVKLLFSVNMRKRLTPELPQGYYGNGFVLACAESKVQDLVNGNIYHAVKSIQEAKSRITDEYVRSTIDLLEDKTVKTDVSCSLVISQWAKLGLEELDLGGGKPMYMGPLTSDIYCLFLPVASDNDAIRVQMSLPEEVVKRLEYCMVKFLDGKDNEDENSRAC

SEQ ID NO: 214 - DNA, 1356 bp, Arabidopsis thaliana
atggctcccataacttttagaaaatcttacactatagtaccggccgaaccaacgtggagcggtaggtttcccttagccgagtgggatcaagttggtacaattactcacattcccaccctttacttttacgacaagccatctgaatctttccaaggcaatgtagtcgaaatcctaaaaacctcgttgagccgtgtgctagtccatttttaccctatggctggccgtctcagatggctccctcggggacggttcgagctcaattgtaacgccgagggagtggaattcattgaagcggaatctgaggggaagctttcggatttcaaagacttctctcctacgccggaattcgagaatcttatgccgcaagtaaactataaaaaccctatcgaaacgattcctctatttttagctcaggtaaccaaattcaaatgcggtggaataagccttagcgtcaacgtttcccacgcgatcgtagatggccaaagcgcgcttcacttaatatcggaatggggaagactcgcgcgcggtgaaccgttagaaaccgttccatttctagaccggaaaatcctctgggctggtgaaccgctcccaccgtttgtgtcgcccccaaagttcgaccacaaagagtttgatcagccaccgtttttgatcggagaaacggacaatgtagaagagagaaagaagaaaacgattgtggtgatgctaccactgagcacatctcagctgcagaagctacgaagtaaagccaacggaagcaaacactctgacccggcgaaagggtttacaaggtacgagaccgtcaccggacacgtgtggaggtgcgcgtgtaaagcacgtggccactctccggagcaaccaacggctctaggaatctgtatagatactcgtagtcggatggagccacctctgccacgcggctacttcggcaatgctactcttgacgtggtcgcagcaagcacctcaggtgaactgatatcgaatgaattgggtttcgcggcgagtttaatcagtaaagccataaagaatgtaacaaacgaatacgtgatgattgggatagagtatcttaagaaccaaaaagatctgaagaagtttcaagatctacatgccttgggaagcacggaaggtccattctacggaaacccaaatcttggagtggtgagctggttaactttgccaatgtacggccttgatttcggatggggcaaagagttctacacgggaccaggcacgcatgactttgacggcgactcgctgatcttgccggatcaaaacgaagatggctcggtgattctcgcgacgtgtctacaggtggctcacatggaggccttcaagaaacacttttatgaagatatctag

SEQ ID NO: 215 - protein, 451 aa, Arabidopsis thaliana
MAPITFRKSYTIVPAEPTWSGRFPLAEWDQVGTITHIPTLYFYDKPSESFQGNVVEILKTSLSRVLVHFYPMAGRLRWLPRGRFELNCNAEGVEFIEAESEGKLSDFKDFSPTPEFENLMPQVNYKNPIETIPLFLAQVTKFKCGGISLSVNVSHAIVDGQSALHLISEWGRLARGEPLETVPFLDRKILWAGEPLPPFVSPPKFDHKEFDQPPFLIGETDNVEERKKKTIVVMLPLSTSQLQKLRSKANGSKHSDPAKGFTRYETVTGHVWRCACKARGHSPEQPTALGICIDTRSRMEPPLPRGYFGNATLDVVAASTSGELISNELGFAASLISKAIKNVTNEYVMIGIEYLKNQKDLKKFQDLHALGSTEGPFYGNPNLGVVSWLTLPMYGLDFGWGKEFYTGPGTHDFDGDSLILPDQNEDGSVILATCLQVAHMEAFKKHFYEDI

SEQ ID NO: 216 - DNA, 1374 bp, Arabidopsis thaliana
atggttgctgagaacaataaaaacaaggacgtaacactctctgcatcaatggacaacaacaacaacaacatcaaaggaactaacattcatcttgaggttcatcaaaaggaaccagctttggtcaaacctgaatccgagacacgaaagggcctttacttcttgtcgaatcttgaccagaacatcgccgtgattgttcgtacaatctactgtttcaaatccgaggagagagggaacgaggaagcagtccaagtgatcaagaaagctctgagtcaagttcttgttcattactatcctctcgctggacgcctcaccatcagtcctgaaggtaaactcacagttgactgtaccgaagaaggagttgtgtttgtggaagcagaagcaaactgtaaaatggatgagattggtgacattaccaaacccgatcctgaaactctagggaagcttgtgtacgatgtcgtagacgccaagaacattcttgagatccctcctgttaccgctcaggtgactaaattcaaatgtggagggtttgttctcggactctgtatgaatcactgtatgttcgatggaattggagctatggagtttgttaactcatggggtcaagtcgctagaggcttaccattaacaactcccccattctcagacagaaccattctcaatgctcgaaaccctccaaagatcgagaatctccaccaagaatttgaagagatcgaagataaatccaacatcaactctctttacaccaaagagccaactctctacagatccttctgctttgatccagagaaaatcaagaaacttaagctccaagcaacagagaacagtgagtctctcctcggtaactcatgcacaagttttgaggctttatctgcttttgtctggagagcaagaaccaagtcgttgaagatgttgagtgatcagaaaacgaagcttctcttcgccgttgatggtagagccaagttcgagcctcaactgccaaaagggtacttcggaaatggaattgttctcacaaactccatctgtgaagctggggagcttatcgaaaaaccgttgagtttcgcggtgggattagtcagagaagccattaagatggtaactgatgggtacatgagatctgctattgattacttcgaagtcacgagagcaagaccttctctttcctcgactcttctgatcactacatggtcaagattgggtttccacacgacagatttcggttggggagaaccgattttatccggtccagtagctttgcctgagaaagaagtaactctgtttttgtctcatggagaacagaggagaagcatcaatgtgcttcttggacttcccgctacagccatggatgtgtttcaagaacagtttttacagatataa

SEQ ID NO: 217 - protein, 457 aa, Arabidopsis thaliana
MVAENNKNKDVTLSASMDNNNNNIKGTNIHLEVHQKEPALVKPESETRKGLYFLSNLDQNIAVIVRTIYCFKSEERGNEEAVQVIKKALSQVLVHYYPLAGRLTISPEGKLTVDCTEEGVVFVEAEANCKMDEIGDITKPDPETLGKLVYDVVDAKNILEIPPVTAQVTKFKCGGFVLGLCMNHCMFDGIGAMEFVNSWGQVARGLPLTTPPFSDRTILNARNPPKIENLHQEFEEIEDKSNINSLYTKEPTLYRSFCFDPEKIKKLKLQATENSESLLGNSCTSFEALSAFVWRARTKSLKMLSDQKTKLLFAVDGRAKFEPQLPKGYFGNGIVLTNSICEAGELIEKPLSFAVGLVREAIKMVTDGYMRSAIDYFEVTRARPSLSSTLLITTWSRLGFHTTDFGWGEPILSGPVALPEKEVTLFLSHGEQRRSINVLLGLPATAMDVFQEQFLQI

SEQ ID NO: 218 - DNA, 1302 bp, Arabidopsis thaliana
atgaaaattaacatcagagattccaccatggtccggcctgccaccgagacaccaatcactaatctttggaactccaacgtcgaccttgtcatccccagattccatacccctagtgtctacttctacagacccaccggcgcttccaatttctttgaccctcaggtcatgaaggaagctctttccaaagcccttgtccctttttaccctatggctggtcgcttgaagagagacgatgatggtcgtattgagatcgattgtaacggtgctggtgttctcttcgttgtggctgatactccttctgttatcgatgattttggtgattttgctcctacccttaatctccgtcagcttattcccgaagttgatcactccgctggcattcactctttcccgcttctcgttttgcaggtgactttctttaaatgtgggggagcttcacttggggttgggatgcaacatcacgcggcagatggtttctctggtcttcattttatcaacacatggtctgatatggctcgtggtcttgacctaaccattccacctttcattgatcgaacactcctccgagctagggacccgccacagcctgcttttcatcatgttgaatatcagcctgcaccaagtatgaagatacctcttgatccgtctaaatcaggacctgagaataccactgtctctatattcaaattaacacgagaccagcttgttgctcttaaggcgaaatccaaggaggatgggaacactgtcagctacagctcatacgagatgttggcagggcatgtgtggagatcagtgggaaaggcgcgagggcttccaaacgaccaagagacgaaactgtacattgcaactgatggaaggtctagactacgtccgcagctgcctcctggttactttgggaatgtgatattcactgcaacaccattggctgttgcaggggatttgttatctaagccaacatggtatgctgcaggacagattcatgatttcttggttcgtatggatgataactatctgaggtcagctcttgactacctggagatgcagcctgatctgtcagcccttgtccgcggtgcacatacctacaagtgcccaaatttgggaatcacaagctgggttagattacctatttatgatgcagactttggttggggtcgtcctatctttatgggacctggtggaattccatacgagggtttgtcttttgtgctaccaagtcctactaatgatggcagcttatccgttgccattgccctccaatctgaacacatgaaactgtttgagaagtttttgtttgagatatga

SEQ ID NO: 219 - protein, 433 aa, Arabidopsis thaliana
MKINIRDSTMVRPATETPITNLWNSNVDLVIPRFHTPSVYFYRPTGASNFFDPQVMKEALSKALVPFYPMAGRLKRDDDGRIEIDCNGAGVLFVVADTPSVIDDFGDFAPTLNLRQLIPEVDHSAGIHSFPLLVLQVTFFKCGGASLGVGMQHHAADGFSGLHFINTWSDMARGLDLTIPPFIDRTLLRARDPPQPAFHHVEYQPAPSMKIPLDPSKSGPENTTVSIFKLTRDQLVALKAKSKEDGNTVSYSSYEMLAGHVWRSVGKARGLPNDQETKLYIATDGRSRLRPQLPPGYFGNVIFTATPLAVAGDLLSKPTWYAAGQIHDFLVRMDDNYLRSALDYLEMQPDLSALVRGAHTYKCPNLGITSWVRLPIYDADFGWGRPIFMGPGGIPYEGLSFVLPSPTNDGSLSVAIALQSEHMKLFEKFLFEI

SEQ ID NO: 220 - DNA, 1281 bp, Arabidopsis thaliana
atggccgactcattcgagctaattgtaacccgaaaagaacctgttctcgtctctccagcctccgaaactccaaaaggtctccattatctctcaaatctcgatcaaaacatcgccatcattgtcaaaacattctactacttcaaatcaaactcaagatccaacgaagaatcctatgaagtcatcaagaagtcactctccgaggttctcgttcactactatcctgccgcagggagactcacgatcagtcctgaaggaaagatcgctgtggattgcaccggagaaggagttgtagtggtggaagctgaggccaattgtgggatagagaagataaagaaggctatatcggagattgatcaaccagagactcttgaaaagttggtttacgacgttcccggtgctcggaatattctcgagattcctccagtggttgttcaggtgacaaatttcaagtgtggagggttcgtgctaggactaggcatgaaccacaatatgttcgatggtatcgcagccatggagttcctcaactcttgggccgagacggctcgtggccttcctctctccgttccacctttcttggaccgcacacttctccgaccacgaaccccaccaaagatcgaattcccacacaacgagttcgaggacctcgaagacatctccggcaccggaaaactctactccgacgagaaactcgtctacaaatccttcctcttcggacccgaaaaactcgagaggcttaagatcatggcagagacgagatccacgacttttcaaaccctaaccgggtttctgtggagagctcgttgtcaagccttagggcttaaacctgatcaacggatcaagcttctctttgctgcagatggaaggtcgagattcgttccggaacttcctaaaggatattccggtaacgggattgtgttcacttattgcgttacaacggcaggtgaagtgactttaaaccctctttctcattcagtgtgtttggtcaaaagagccgttgaaatggtcaacgacggtttcatgaggtcagcgattgattactttgaggtgactcgagctaggccgagcctaacggcaacacttctgatcacgtcgtgggcaaaactgtcgtttcatactaaggatttcggttggggtgaaccggttgtatctggaccggtcggtttacctgagaaggaagtgattctgtttctgccatgtggtagtgacacgaagagtatcaatgtgctgcttggacttcctggctcggctatgaaagtgttccaagggattatggatatatga

SEQ ID NO: 221 - protein, 426 aa, Arabidopsis thaliana
MADSFELIVTRKEPVLVSPASETPKGLHYLSNLDQNIAIIVKTFYYFKSNSRSNEESYEVIKKSLSEVLVHYYPAAGRLTISPEGKIAVDCTGEGVVVVEAEANCGIEKIKKAISEIDQPETLEKLVYDVPGARNILEIPPVVVQVTNFKCGGFVLGLGMNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTKSINVLLGLPGSAMKVFQGIMDI

SEQ ID NO: 222 - DNA, 1347 bp, Aquilegia sp
atggtcatggtgagcatcaagaggacttgcacagttaagcctaatgagaaaaccccagatgttaagctctggctatcagagtgtgaccagataaaggcttatacacatgcaccctcattctacatatatcttcctcaaaacttagataactactcagtttcatctccattcgaaaccttgaaaagttcattaagccatgtattggtaccatattacccgctagcaggtcgtttgaattggattggtggaggccggtttgagcttaattgcaatgggatgggagctgaaattgttgaagctgaatcacaattcgaaatccaagatttaggtgactttcgccctacgccagagacaaaaaagctccttccacctgttgattacaccagagaaattagtgagttgccattgttgctagtgcaactcacaagattcaaatgtggtggcattagcattggagtggcaatttcacatattgtggcagatggtaaaggtgcacttgggtttattagctcatgggccaattatgctcgtggcgagtacaaattagttgttgagccttatcatgatcgaacccttttttacaaaggtgatccattggcaaacccacgctttgatcatcatgagctcaaaacttctcccaccttaattggacatgaggatgccgaggaggagcggaagaaagaatgcataaacacaatgttgaaattgtcgaaaactcaagtaaacaaactcagggaactggccaatgaaggaagagatgcaaccagccgtcaatacagtaggtttgaggccatggcagcacacatatggaggtgtgcatctaaggcacgtaaacttcaaaatgcgcagttaacatcattgcgtattgctgcagattgtcgcaaccgcttgaaaccaactttgccaccaggttactacggcaatgtgattatggtaaccacaccaatagctgaagtgagtaaattgttggtgggattaggtgatgcttgtggcattattagtcaaggtgtagaaaagcttactgatgattacataaagtcagccacagactttttggcaagtcaagaggatttgactcaatggagaactggatttcacactgatagtaagaaagggctttttttaggtaatccaaatatggcaataactagttggtttgggctacccatttatgatgcagattttggatggggaaagcccatatttatgggccctgcaggcttgggttttgatggtagggcctttatcattcctggaagtgatgaagatggatcgtttgtgattgctattcgtctacaagtgactcacatggatgatttcgagaaattcttttatgaaaatatttga

SEQ ID NO: 223 - protein, 448 aa, Aquilegia sp
MVMVSIKRTCTVKPNEKTPDVKLWLSECDQIKAYTHAPSFYIYLPQNLDNYSVSSPFETLKSSLSHVLVPYYPLAGRLNWIGGGRFELNCNGMGAEIVEAESQFEIQDLGDFRPTPETKKLLPPVDYTREISELPLLLVQLTRFKCGGISIGVAISHIVADGKGALGFISSWANYARGEYKLVVEPYHDRTLFYKGDPLANPRFDHHELKTSPTLIGHEDAEEERKKECINTMLKLSKTQVNKLRELANEGRDATSRQYSRFEAMAAHIWRCASKARKLQNAQLTSLRIAADCRNRLKPTLPPGYYGNVIMVTTPIAEVSKLLVGLGDACGIISQGVEKLTDDYIKSATDFLASQEDLTQWRTGFHTDSKKGLFLGNPNMAITSWFGLPIYDADFGWGKPIFMGPAGLGFDGRAFIIPGSDEDGSFVIAIRLQVTHMDDFEKFFYENI

SEQ ID NO: 224 - DNA, 1299 bp, Brassica napus
atggccggctcattcgagttcgttgtgacaagaaaaaaccctgtactcgttactccaaagtctgaaactccaaaaggtctttactacctctcgaatctcgatcaaaacatcgccgtcacggtcaaaacgttttattacttcaaatcaaagtcaaaaactaaccaagattcctacaatgtgatcaagaaatctctctctgaggttattgttcattattaccctgtggccggacggctgaccatcagccctgaagggaagatcgccgtgaattgcaccggagaaggagcagtgttggtggaagctgagactaattgtgggatagagatgatcaaagaggcgatctctgagaatagaatggagatgctcgaggaacttgtttatgacattcctggtgcccggaatattcttgagattccaccggtggtagttcaggtgacaaacttcaaatgtggcggttttatcctaggactaggcatgagccacaacatgttcgatggagtggcggctgcagaattcttgaactcgtggtgcgagacggcaaagggcctccctttatctctgccacctttcttggaccgtgccattctccaaccaagaaagccaccaaaaatcgagttcccacacaacgagtttgacgaaatcgaagacatttctggcactggaagactctacgacgaagagaaactcgtctacaaatcatttctcttcgaaccgcaaaaactagagaagctcaagactatgacaaatgaggaagatagtaatagtaacaataaggttacaacatttcaagctttaaccggatttctttggaaatcacggtgcgaagcgctacgatttaaacaggaccaacgagttaaacttcttttcgcggctgatggacggtctagattcatccctcctctcccaaaaggatattgcgggaacgggatagtgttaacaggtttggtgacgtcatcaggagaattggttgggaaccctctttctcgttcggttggtctagttaagagtgtggttgatttggttaccgacagtttcatgagatcggctattgattacttggaggttaaccggaacaggccgagtatgacaggaacacttctgattacgtcgtggtcaagattgtcactacataaactggattttggatggggagaacccgttttctctggaccggttggtttaccagggagagaagtgatcctgtttttacctggtctcgaagatatgaagagtatcaatgtgttccttggacttcctgcctctgctatgaaagtgtttgaagagcttatgaagatttga

SEQ ID NO: 225 - protein, 432 aa, Brassica napus
MAGSFEFVVTRKNPVLVTPKSETPKGLYYLSNLDQNIAVTVKTFYYFKSKSKTNQDSYNVIKKSLSEVIVHYYPVAGRLTISPEGKIAVNCTGEGAVLVEAETNCGIEMIKEAISENRMEMLEELVYDIPGARNILEIPPVVVQVTNFKCGGFILGLGMSHNMFDGVAAAEFLNSWCETAKGLPLSLPPFLDRAILQPRKPPKIEFPHNEFDEIEDISGTGRLYDEEKLVYKSFLFEPQKLEKLKTMTNEEDSNSNNKVTTFQALTGFLWKSRCEALRFKQDQRVKLLFAADGRSRFIPPLPKGYCGNGIVLTGLVTSSGELVGNPLSRSVGLVKSVVDLVTDSFMRSAIDYLEVNRNRPSMTGTLLITSWSRLSLHKLDFGWGEPVFSGPVGLPGREVILFLPGLEDMKSINVFLGLPASAMKVFEELMKI

SEQ ID NO: 226 - DNA, 1302 bp, Brassica napus
atgaaggttgaaaccataaaaccatcttccacaaccccagatgatctccgaactctccaactctctatctatgatcacttcctccctcccatttacacagtcgcctatctcttctacaccaaagatgagttgatgatctcaccagaacacacttcccacaaactcaaaacttctctgtccgaaaccttgaccaaattctacccccttgccggaagaatcaacggagtcactgtcgactgtaacgacgaaggagctgttttcgtcgacgctcgtgtcgataactgttccctctctggttttctcgcatctccagatctcaatgccctccaacagttgcttcctctagacgccgtccagaacccatacgaggctgcttccacatggcctctgttgctcgtgaaggcgacttacttccaatgcggaggcatggccatcggagtctgcatcactcacaaaatcgccgacgcagcctccatgtcgactttcattcggacttggtctgctgaggctcgaggagaggccgggaacacggtgatggatcctaagttttccgcagcgaatttttacccaccagccaatgatacctataagcttccggtggacgaaaaagccaacaagagaagcagcatcacgaagagattcgtcttcggtgcatctaagttggaagagctcaggaccaaagccactagtccagaatccgcagacatacctacgcgcgtagagagcgtcactgcccttctctggaagtgcttcgtctttgcttcatccttagacacttgtggtcgcaaagttctgatccagctcgctgacttgcgctccaagctaccgtcccttctcccagaaagcctgatcgggaacgtcatgttctcctctgtggtattaagtactgctcaaggggaggaagtgaaaattgaagaggccactagagacttacgaaagaagagggaggacttgcaaactatgatccaagacgaggatggttcatcttcgatgatcggttctaaactggcgaatcttatgctcactaattatgcccggatgagctacgagacacacgagccctacacagtgagtagctggtgcagattaccactttacgaggctagctttggatggggataccctgtttgggttgttggaaatgtggctcccacgtttgaaaacattgccatgctgatcgattccaaggacggacatgggattgaagcttttgtcacgctgcctgaagagaacatgtcctcgctcgagcaaaactcggaacttctcgcctttgcttccttgaatccttgtgtcttggtctaa

SEQ ID NO: 227 - protein, 433 aa, Brassica napus
MKVETIKPSSTTPDDLRTLQLSIYDHFLPPIYTVAYLFYTKDELMISPEHTSHKLKTSLSETLTKFYPLAGRINGVTVDCNDEGAVFVDARVDNCSLSGFLASPDLNALQQLLPLDAVQNPYEAASTWPLLLVKATYFQCGGMAIGVCITHKIADAASMSTFIRTWSAEARGEAGNTVMDPKFSAANFYPPANDTYKLPVDEKANKRSSITKRFVFGASKLEELRTKATSPESADIPTRVESVTALLWKCFVFASSLDTCGRKVLIQLADLRSKLPSLLPESLIGNVMFSSVVLSTAQGEEVKIEEATRDLRKKREDLQTMIQDEDGSSSMIGSKLANLMLTNYARMSYETHEPYTVSSWCRLPLYEASFGWGYPVWVVGNVAPTFENIAMLIDSKDGHGIEAFVTLPEENMSSLEQNSELLAFASLNPCVLV

SEQ ID NO: 228 - DNA, 1338 bp, Gossypium hirsutum
atggatgttagtgtaaagagatggagcatgatacgccctgcccaagatactcctaaagaaaggcaatggatttcaaatctggacatggtgataacaacataccatgtccctttgctgtttttctacaaaccaaatggctcctctgatttctttaagcctcaagtgctacaggaggctttaagcaagactcttgtgcaattctatcctatggctgggaggttgggacatgatgaaaatggtaggctcgagatagtatgcaacgcagagggtgttctgtggatagaagctgaaactacatcggccatggatgatctcgacgattttactccctgctcaaaactgaggaaactggttcccacggctgattactctggagatatcagttcttatccgcttattatggctcaggtaactactcttaaatgcggtggagtttgtcttggaatagcaactcatcatactttgactgatggcacaacgaccttacatttcattaatagttggtctgaaatggcaagaggcttgccccaaattagcatgccaccagttattgaccgaacccttcttcgagcaagagtgccaccaatccctagatttcatcatctcgaatatgaccgacctccttccttatacacctctacgtcacttggccctaataaccataaaccctcaactgtatatgttttcaagatcacacaaaatcaacttaataccctaaaagccaagtcatgggaacatggaaacaaaaccaattacagcacctacaccattctagttgcatacatatggcgctgtgcaactaaagcttgggacctctcatatgatcagccaaccaagttacacatgccaactgatggacgccccagactacatcctcccctcccatcaacgtacttgggtaacgcaatgtttgcggcttcattaattgctctatctggaaatctgcaatcagaaccgtttgtaaataccctagaacgagttcatggaacattgcaaaggatgaataatgagtatctaagatcagctcttgactacctagaaacactgccagatataacagttgccaggagaacaccggacacttaccattgcccaaacctaagtatcaacaaatggacccgactgtctttatatgatgcagattttggatggggtcgaccaatatacatgggtccagcaaacgttgtccatgaaggaaaaatatacatactaccaagtccaaccaatgatgggagcttgtcactggtagcatgcctacagactgctcatatgaaactctttgagaaacatctatacgaaggcttgaagtcatttgacaagatcaaagctcgatattag

SEQ ID NO: 229 - protein, 445 aa, Gossypium hirsutum
MDVSVKRWSMIRPAQDTPKERQWISNLDMVITTYHVPLLFFYKPNGSSDFFKPQVLQEALSKTLVQFYPMAGRLGHDENGRLEIVCNAEGVLWIEAETTSAMDDLDDFTPCSKLRKLVPTADYSGDISSYPLIMAQVTTLKCGGVCLGIATHHTLTDGTTTLHFINSWSEMARGLPQISMPPVIDRTLLRARVPPIPRFHHLEYDRPPSLYTSTSLGPNNHKPSTVYVFKITQNQLNTLKAKSWEHGNKTNYSTYTILVAYIWRCATKAWDLSYDQPTKLHMPTDGRPRLHPPLPSTYLGNAMFAASLIALSGNLQSEPFVNTLERVHGTLQRMNNEYLRSALDYLETLPDITVARRTPDTYHCPNLSINKWTRLSLYDADFGWGRPIYMGPANVVHEGKIYILPSPTNDGSLSLVACLQTAHMKLFEKHLYEGLKSFDKIKARY

SEQ ID NO: 230 - DNA, 1302 bp, Glycine max
atggcgaataaactgaatataaggctaggagaaccaactctggtgccaccagcagaagaaacggaaaagggtctttactacttcctttcaaaccttgaccagaacatagcacatccagttcgaacggtttacttttataataagtctgcatgtagagggaacgaggaagcagcacaagtaataaaggatgctttgtcgaaggttcttgttcactattaccctatggctggaagattggccataagttcagaagggaaactgatcatagagtgcacaggtgagggtgttgtgtttgttgaggctgaagaagcaaactgtgtgataaaggacttgggagatttgacaaaacaacctgaccttgaaactcttggaaaactggtttatgatatccccggtgcaaccaacatgcttcagatacctcctttgctaattcaggtgacaaagttcaaatgtggtggatttgttttgggcgtaaacgtgaaccattgcatggttgatggtataagtgctatgcaattcgtgaacgcatggggtgagacagccagaggcatggacttgagcatttcaccagttctggaccgaactatactaagaacacgaaatcctccaaagatagagtatccacaccacgaattcgacgaaattgaagatgtatcaaatgtcacaaaagtctatgaggaagagatcctctacgagtccttttgtttcgacccagataagcttgagttgcttaagaaaatggccacatcagaagatggtgttgtaaagaagtgctctacttttgaagcacttacagcttttgtgtggagagctagaagtgaagccttagggatgcacatggaccctaatcaacaaaccaagctactttttgctgttgatggaaggtctaaattcgtgcctccaataccaaaggggtactttggcaatgctattgtgttttcaaatgctctatgcaaggtagaggagttagtgaataatccactgtcatttagtgtgggattggttggcaaagcaattgacatggtgacagacagttacatgagatctgctattgactattttgaagtgaaaagatcaaggccttccttaactgcaacacttttgatcacaacatggactaggatacctttccgaagtgcagatttcggatgggggaagcccttcttttttgggcctgtaactttgccagggaaggaagtcattttgttcttgtctcataacgaagaaagtaaaagcataaacgtgctcctaggtttgcctgcttctgccatgaaaaggtttgaaaggctgatggagatatga

SEQ ID NO: 231 - protein, 433 aa, Glycine max
MANKLNIRLGEPTLVPPAEETEKGLYYFLSNLDQNIAHPVRTVYFYNKSACRGNEEAAQVIKDALSKVLVHYYPMAGRLAISSEGKLIIECTGEGVVFVEAEEANCVIKDLGDLTKQPDLETLGKLVYDIPGATNMLQIPPLLIQVTKFKCGGFVLGVNVNHCMVDGISAMQFVNAWGETARGMDLSISPVLDRTILRTRNPPKIEYPHHEFDEIEDVSNVTKVYEEEILYESFCFDPDKLELLKKMATSEDGVVKKCSTFEALTAFVWRARSEALGMHMDPNQQTKLLFAVDGRSKFVPPIPKGYFGNAIVFSNALCKVEELVNNPLSFSVGLVGKAIDMVTDSYMRSAIDYFEVKRSRPSLTATLLITTWTRIPFRSADFGWGKPFFFGPVTLPGKEVILFLSHNEESKSINVLLGLPASAMKRFERLMEI

SEQ ID NO: 232 - DNA, 1371 bp, Glycine max
atggtaaccattgtgggttcttacaatgtcactccaaatcaaccaactccaaaggatcctttatggctatccaatagtgacctaatcgggttccaaggttatgtacccactctttacgtttacaaagcaaaacccaattatagcaacaacataattgagaggttgagaaactctcttagcaagcttttggtgtactactatcctgttgctggcagattgagcttgacaaaaagtggtcgaatggaagtggattgtaacgctaagggagtgacattgattgaagcagaaaccacaaacacatttgctgattatggagactttactacaccttcagagtccacagatgaacttgttccaaaaattgattctactcaacctatagaggagactccaatactggtagtgcaattaacaaggttccgtggtggtgatgaaggccttgccgttggatttggtatgtttcattctttgactgatgcaaccggcatcattcacttcatgaacagatgggcaaagctggctagaggggaagaactaaaccctaatgaaattccgtttctcgatcgaacaatactccaattattttcatcatcatcgcaacacgtggatcaaccggagtggaagcctataacacaagcacaaggagtagagcaaaagcaaagaagttgttctttgttaaaactcacatcaagccaagtggagaggctaaagaagaagactaatgatgaaagtccaaaagaattaggggtaagaccttatagcagatttgaagctattgctgctcatatatggagatgtgcatctaaggctcgtgctgaatattcaaattcaaatcacccaactatagttcggtttagtgttaatattcgtaataggttattgactccacctatccctgagagttattttgggaatgctttggcaagaacaacgacacctaaatgctatgagggagatatcatatcgaaccctttaagttttgctgctcaaaagttaagggaagcagtaaatccgattacgggtgagtatataaagtcacaattaagtgttggtttagggcaagagcaattggatcacataagggcttttttcatgagacaagaacacggtatgaaaacaccctatattgctggggaacataacaacgttattctccttacaagcttgatgaccatgccagtgtatgaagcagattttggttggggaaagcctatgcaatttggtttaccacgtgggtctctagatgatagggtaggaattcttccaagcccagatggagatggtgttgttgtcaacgtgtttttccaggaagcaattctgcagcgtttcaaaaagttgttctacgaggatgtgtatatatcctcattgtag

SEQ ID NO: 233 - protein, 456 aa, Glycine max
MVTIVGSYNVTPNQPTPKDPLWLSNSDLIGFQGYVPTLYVYKAKPNYSNNIIERLRNSLSKLLVYYYPVAGRLSLTKSGRMEVDCNAKGVTLIEAETTNTFADYGDFTTPSESTDELVPKIDSTQPIEETPILVVQLTRFRGGDEGLAVGFGMFHSLTDATGIIHFMNRWAKLARGEELNPNEIPFLDRTILQLFSSSSQHVDQPEWKPITQAQGVEQKQRSCSLLKLTSSQVERLKKKTNDESPKELGVRPYSRFEAIAAHIWRCASKARAEYSNSNHPTIVRFSVNIRNRLLTPPIPESYFGNALARTTTPKCYEGDIISNPLSFAAQKLREAVNPITGEYIKSQLSVGLGQEQLDHIRAFFMRQEHGMKTPYIAGEHNNVILLTSLMTMPVYEADFGWGKPMQFGLPRGSLDDRVGILPSPDGDGVVVNVFFQEAILQRFKKLFYEDVYISSL

SEQ ID NO: 234 - DNA, 1320 bp, Glycine max
atgttgatcaatgtgaagcaatccaccatggttcggccggcggaggagacgccgcggagggcgttgtggaactccaacgtggatttggtggtgccgaacttccacacgccgagcgtgtatttctacaggccaaacggggtctccaatttcttcgacgccaaggtgatgaaggaggctctgagcaaggtcttggtccctttctacccaatggccgcacgcctccgccgggacgacgacgggcgcgtggagatatactgcgacgctcagggcgtgctcttcgtggaggctgagaccactgccgccatcgaggacttcggcgacttctctcccaccctggagctccggcagctcatcccctccgtggattattctgccggtatccactcctatccgctgttggtgctacaggtaacatatttcaaatgtggaggggtctcattaggtgttggtatgcaacaccatgtagcagacggagcatctggtcttcactttatcaatgcatggtcagatgttgctcgtggcttggatatttccctccccccattcattgacaggacactactccgtgcccgggatccacctcttcctgtttttgatcacattgaatacaagcccccaccagccactaagaagactactcccctgcaaccctcaaaaccattaggctctgacagtactgctgttgccgtctctactttcaaattgacccgtgaccaactgagcaccctcaagggtaagtccagagaagatggcaacacaatcagctacagctcttatgagatgttggctggccatgtatggagaagtgtctgtaaggcaagagcacttcctgatgaccaagaaaccaaattgtacattgcaaccgatggacgggcgaggctgcaacctcccctcccccatggttactttggcaatgtcatcttcaccaccactcgcatagcagtggctggtgatctcatgtcaaaaccaacatggtatgctgctagcagaatccacgacgcattaatacgaatggacaatgaatatttgagatcggctcttgactatctagagctgcagcctgatctaaaatcccttgttcgtggagcacatacttttagatgtccaaatcttggtatcactagctgggcaaggcttccaatccatgatgctgactttggttggggaagacccattttcatgggacctggtgggattgcatacgaggggctatctttcataatcccaagctcaacaaatgatgggagcctgtcgttggcaattgctctgccgcctgagcaaatgaaagtgtttcaggaattgttttatgatgacatttga

SEQ ID NO: 235 - protein, 439 aa, Glycine max
MLINVKQSTMVRPAEETPRRALWNSNVDLVVPNFHTPSVYFYRPNGVSNFFDAKVMKEALSKVLVPFYPMAARLRRDDDGRVEIYCDAQGVLFVEAETTAAIEDFGDFSPTLELRQLIPSVDYSAGIHSYPLLVLQVTYFKCGGVSLGVGMQHHVADGASGLHFINAWSDVARGLDISLPPFIDRTLLRARDPPLPVFDHIEYKPPPATKKTTPLQPSKPLGSDSTAVAVSTFKLTRDQLSTLKGKSREDGNTISYSSYEMLAGHVWRSVCKARALPDDQETKLYIATDGRARLQPPLPHGYFGNVIFTTTRIAVAGDLMSKPTWYAASRIHDALIRMDNEYLRSALDYLELQPDLKSLVRGAHTFRCPNLGITSWARLPIHDADFGWGRPIFMGPGGIAYEGLSFIIPSSTNDGSLSLAIALPPEQMKVFQELFYDDI

SEQ ID NO: 236 - DNA, 1368 bp, Glycine max
atgccagtgaccttgaaagcttgttacactgtgaagcctatagagacaacatggtgcggacgcgtatctttatctgaatgggatcaaacaggaaatgtaactcacgtccccataatctacttctaccgtactccctcgcaagagagcaacaacaacagcattgcttccaccttgaaagactcattaagcagagtcctagtgccattttatccactagccggtcgtttacactggataaacaatggtcgtttagaacttgattgcaacgccatgggagttcaattcattgaagctgaatcctcatcaagttttgaagatctcggtgatgacttttcaccctcttcagaatacaactaccttgtccccactgtagactacactctcccaattcacggcttgcccttggttctgattcaattaactaacttcaagtgtggtggcgttagtatcggcataacactttcacacgcggttgtggatggaccaagtgcatcacactttattagtgagtgggcaaggcttgcacgcggcgagcctttgcaaacggtgccgtttcatgatcgaaaagtgctacatgccggggacccaccttcggtgccactagcaaggtgtcactctcacacggagtttgatgagcctccgttgttgctcggaaaaacggacaacacggaggaaagaaaaaagaagaccgcaatggttatcctcaaactgagtaagacacaagttgagacattgaaaaagacagcaaattatggcggttatggtaatgatagttatagccgttacgaggctatagctggtcacatatggagaagtgcatgtaaggcaagagggcacaaagaggaccaaccaacaacgcttactgttatcgttgactcgagaagtcgaatggagcctcctttgccaaaagggtattttgggaatgcaactttggacactgttgctactagccttgcgggtgatttggtgtcaaagccgttagggtatgcgtcaagtagaataagagaggctattgagagggttagtgatgagtacgttaggtcggggattgagttcttgaaaaaccaggaggatttgagaaggtttcatcaagatcttcatgcaatagagagtgagaagaaggagcctttttatgggaaccctaatctggctgtggttagttggttgacgttgccgatctatggcgttgattttgggtgggggaaggagctttatatgagtccagcaacgcatgacttcgatggagattttgtgcttcttcctggtccagatggggatggatctttgctggtttgtttaggtctgcaagtggagcatatggatgcgtttaagaaacatttttacgaggacattgagtcaaaatcatga

SEQ ID NO: 237 - protein, 455 aa, Glycine max
MPVTLKACYTVKPIETTWCGRVSLSEWDQTGNVTHVPIIYFYRTPSQESNNNSIASTLKDSLSRVLVPFYPLAGRLHWINNGRLELDCNAMGVQFIEAESSSSFEDLGDDFSPSSEYNYLVPTVDYTLPIHGLPLVLIQLTNFKCGGVSIGITLSHAVVDGPSASHFISEWARLARGEPLQTVPFHDRKVLHAGDPPSVPLARCHSHTEFDEPPLLLGKTDNTEERKKKTAMVILKLSKTQVETLKKTANYGGYGNDSYSRYEAIAGHIWRSACKARGHKEDQPTTLTVIVDSRSRMEPPLPKGYFGNATLDTVATSLAGDLVSKPLGYASSRIREAIERVSDEYVRSGIEFLKNQEDLRRFHQDLHAIESEKKEPFYGNPNLAVVSWLTLPIYGVDFGWGKELYMSPATHDFDGDFVLLPGPDGDGSLLVCLGLQVEHMDAFKKHFYEDIESKS

SEQ ID NO: 238 - DNA, 1347 bp, Glycine max
atggtaaccattaaagcatcttacacagtccttccaaatgaaccaactccggagggccttttatggctatctgatattgatcaagtggcacgtctacgccacacacccaccatctacattttccatgcaaaacacaaccatgatacattaattgagaggatgagaaactctcttagcaagattttggttcactactatccaatagccggtcgattgagaaggatagaaggtagtggtcgattggaattggattgcaatgcaaaaggggtggtgttgcttgaagctgaatccacaaaaacattggatgattatggagactttttacgtgagtccatcaaggacttggttccaacggttgattacacaagccctatagaggaacttccctcgctactagttcaagtaacaacattccatggtggtaaatcctttgccattggagttgccttatgccatatcttgtgtgatggggttggtgccattcagtttatcaactcttgggcaaagttagctcgaggagacacattggagccacatgagatgccatttctggatcgaacagtgctcaagttcccacaccctctgtcgccgccgcgctttgatcacctggagttcaagcctttgccacttatattgggaagatctgacaacacagtagagaaaaacaagaaggttgatgccaccttgctgaagctaacaccagaacaagtggggaagctgaagaagaaggccaatgatgactcaacaaaagaagggtcaagaccttatagcagatttgaagctattgctgcacatatatggagatgtgcctctaaggctcgtaaactagataagaatcaaccaactctagttcggttcaatgccgatattcgcaatagactaattccacctctccctaagaattattttgggaatgctttgtccttaacaacagcatcatgtcacgttggagatgtcatatcaaattctttgagttatgctgctcagaagataagggaagcaattgaagtggttacatatgagtatatatggtcacagatagatgtgattagaggtcaggagcaactggataatgcaagggctttgttctttggacaaaatgaaggaaaggatgccttgttttatgggaaccctaaccttcttattacaagttggatgagcatgccaatgcacgaagcagattttggctggggaaagcctgtgtatttaggtctaggaagtgtatctacacaagatagggcactgattattcaaagccctgatggtgacggctctattattctgtccatacactttcagatggaacatatgcagctgttgaagaaatatttttataaagatatataa

SEQ ID NO: 239 - protein, 448 aa, Glycine max
MVTIKASYTVLPNEPTPEGLLWLSDIDQVARLRHTPTIYIFHAKHNHDTLIERMRNSLSKILVHYYPIAGRLRRIEGSGRLELDCNAKGVVLLEAESTKTLDDYGDFLRESIKDLVPTVDYTSPIEELPSLLVQVTTFHGGKSFAIGVALCHILCDGVGAIQFINSWAKLARGDTLEPHEMPFLDRTVLKFPHPLSPPRFDHLEFKPLPLILGRSDNTVEKNKKVDATLLKLTPEQVGKLKKKANDDSTKEGSRPYSRFEAIAAHIWRCASKARKLDKNQPTLVRFNADIRNRLIPPLPKNYFGNALSLTTASCHVGDVISNSLSYAAQKIREAIEVVTYEYIWSQIDVIRGQEQLDNARALFFGQNEGKDALFYGNPNLLITSWMSMPMHEADFGWGKPVYLGLGSVSTQDRALIIQSPDGDGSIILSIHFQMEHMQLLKKYFYKDI

SEQ ID NO: 240 - DNA, 1317 bp, Lactuca sativa
atgactatcggaactgattcagagaagatgaacctaactgtgaaggaatcagtgacggtgaaaccatcgaaacagacgccgaatcagcgactatggaactcgaatcttgatttgattgtgggtcggatccatttattgaccatatacttttataggccaaatgggtcttcggatttctttgattcggtggttctgaaacaggctctctccgacgttctctgttccttttttccgatggccggacgcctgggtacagatggcgatggcagagttgaaattaactgcaacggcgagggtgttttgtttgtggaagctgaagcggattgtaagattgatgattttggtgagattactccgtcgccggagctacggaggttggcgccgactgtggattactccggcgacatctcttcttatccgctagtcatcacacaggttacacgtttcaagtgtggtggggtttctctagggtgtggagtgcaccatactttatccgatggattctcctccctccatttcatcaacacatgggccgatatagcccgtggcttacccgttgcaatcccaccgttcaatgaccgatcactcctccgtgcgcgggacccacccactcccatgtttgaccatgtagagtaccacccaccaccatcattaataaccccacccgaaaaccacaagtcgcctgcttccaccacgatcctgcggctcacgcttgatcaaatcaacgatcttaaatcaaaaggaaagggtgatggaagtgtgtaccatagcacatttgtaatcctagccgctcacctatggcgatgtgcatgcaaagctcgtggactctcacacgatcaaccaaccaaattgtacgtggccacagacggacgatcgagattgaaccctccactccctcccggttaccttggaaacgttgtgttcacggccaccccgatggctaattcaggcgagtttaaatcagagtcgttggcagacactgcaagaagaatccacagtaagctgtctagaatggacgatcactatatgagatcggccattgactacttggagttgcagtcagatctatcgactctcattcgagggccgacatattttgcgagtccaaatctgaatgtaaatagttggactcgcttaccgttgtatgaatctgacttcggatggggtaaacccattttcatgggacccgcaagcatactttacgagggcacaatttacatcataccgaaccctaatgacgatcgggccttgaagcttgccgtgtgcttagactccgaacacatgtctcttttcaaaaagtacttgtatgacttctag

SEQ ID NO: 241 - protein, 438 aa, Lactuca sativa
MTIGTDSEKMNLTVKESVTVKPSKQTPNQRLWNSNLDLIVGRIHLLTIYFYRPNGSSDFFDSVVLKQALSDVLCSFFPMAGRLGTDGDGRVEINCNGEGVLFVEAEADCKIDDFGEITPSPELRRLAPTVDYSGDISSYPLVITQVTRFKCGGVSLGCGVHHTLSDGFSSLHFINTWADIARGLPVAIPPFNDRSLLRARDPPTPMFDHVEYHPPPSLITPPENHKSPASTTILRLTLDQINDLKSKGKGDGSVYHSTFVILAAHLWRCACKARGLSHDQPTKLYVATDGRSRLNPPLPPGYLGNVVFTATPMANSGEFKSESLADTARRIHSKLSRMDDHYMRSAIDYLELQSDLSTLIRGPTYFASPNLNVNSWTRLPLYESDFGWGKPIFMGPASILYEGTIYIIPNPNDDRALKLAVCLDSEHMSLFKKYLYDF

SEQ ID NO: 242 - DNA, 1293 bp, Morchella esculenta
atgaagatcaacataaaggaatctagtctgatacacccagctgaagatttgcctaataatcaccatctatggctctctaatttagatcgaactcatgaaagaaacaacattcctacagtctacttctataaggcagctgatcatcccaacacctttgaagttaaagtgcttaaggatgctttgagcaaagttcttgtgttgttttatccggcggccggaaggttaggaagagataacaaaggaagacttgagattgtttgtaataatgaaggtgcgttgttcatagaggctgaaacagactacgaattagatgaacttggtgacttgatgctcacagaagtttctcaacttattccatctattgattattcacaaggcatctcttctttcccactctttactgctcaggtcactaagttcaaatgtggtggactatctctcggacttcgaaatcatcacacaatagcagatggctttgcggctctccacttagttaacacatggtgtgatgttgcacgaggcctctccattacaacaccaccgttcattgatagaaccattctccgctgtagagacccaccaaccccaaaatttaaacacgttgagtatgataagccactttccatgagctctgacgcccaaatcctaacatcacaacaaaattgtattgaaatctttaagatcactcctcaacaacttcaaaccttgaaaaacaaggtaaagaatgttgatggcaaaacaaagtacactacctatgagatcttaactgcacatatatggcgttgcacatgcaaagcacgtgctttaccttatcatcaactaactaagttactcgtacccgtcgatggtcggtctagattgcatcctccacttccacctggcttttttggtaatgtagtctttacggcaacactagttgttttatctggcgagattctagcagagacattaaaggatactgttgaaagaattcataacgaattaaagagaatggatgatgagtatatgagatcggcgattgattacttggaagttttggatgacctaacacctaccttccgaggcgccaatacttgtcgatgcccaaacattagcattgttagttggatgagactgcctttctatgatgctgattttggaatgggaaaacccatatttgtgaggcctgcaaatccacttgaaggcaagggaaacataatgagaactcaaagtgatgatggaagttgccaattggccatatgcctacaggaagatcacatgcaatccttccaaaagttgttttatgaattttga

SEQ ID NO: 243 - protein, 430 aa, Morchella esculenta
MKINIKESSLIHPAEDLPNNHHLWLSNLDRTHERNNIPTVYFYKAADHPNTFEVKVLKDALSKVLVLFYPAAGRLGRDNKGRLEIVCNNEGALFIEAETDYELDELGDLMLTEVSQLIPSIDYSQGISSFPLFTAQVTKFKCGGLSLGLRNHHTIADGFAALHLVNTWCDVARGLSITTPPFIDRTILRCRDPPTPKFKHVEYDKPLSMSSDAQILTSQQNCIEIFKITPQQLQTLKNKVKNVDGKTKYTTYEILTAHIWRCTCKARALPYHQLTKLLVPVDGRSRLHPPLPPGFFGNVVFTATLVVLSGEILAETLKDTVERIHNELKRMDDEYMRSAIDYLEVLDDLTPTFRGANTCRCPNISIVSWMRLPFYDADFGMGKPIFVRPANPLEGKGNIMRTQSDDGSCQLAICLQEDHMQSFQKLFYEF

SEQ ID NO: 244 - DNA, 1398 bp, Medicago truncatula
atggtgaacatccacatctaccgttcatacacagtaacaccttcagagaaaacaccaaccaccacactctctctttccctctgtgatcaactcaagctccctaatcatggataccaactttacctcttcacaaacaaaaaccattcatcttcatcactcatctcttcaacaaacattctcataacctctctctccaaaacactcactcactactatccctttgcaggtagattaagctggatcaaaccacaaaaccacttactacaacttcattgcaacaacaaaggtgttcaattcttagaagccacgtgtgatatcactttaaaagattttggtagttttgattctacacatgttgtccaaaaacttgttccaaagattaactatgatgttccagttgaagatcttcctttattggttgttcagttcaccaagtttccttgtgggtcactcactcttggtctttctatgggtcgttctgttcttgatggttcttctgctggtagtttcattagctcatgggctaaacttgccaaaggtgagagtttagattcaagtttgataccatttctagataaaacattgttggattcaaaaatccttcatttaccaccacgttttcatcatcatgagttttctccaccacccctttgggaaaatagtagtaataactcaacacatttgagtaaaaacccactctttgccactaccatgttgaaattcaccaaaaaacaagttgaaaaacttaagaacaaagccaataacaatgaaaacaaggtacgaggttatactagttttgaggttattagtggttacttatggaggtgtgttagtaaagtgcgttttgaaggaaattggaaccaaccaacaaggttaacaactttggttaattgtagaaataggttgaatccacctttgcctatgaattattttgggaatgcaacttttcctacagtgacacaaacttgttcatttgatgatgttgtgaacaagcctttttgttctgtggttgggaaagtgagggaagctgttaaaaaggtgaatgatgagtatgtaagatcagttcttgattatgtagcaaatcagaaagatatgaatttgttaagggacaagttttataattttgctaaaagaaatggacaatttggtggtgaaccgaatttgtatgttgttggttggactaattttccgtttaatgagtccgattttgggtgggggaaacctgattgtatggttcctggtattgttaattccgatggtattggtaaggcttatattcttgatgaagctaatggtgatggttttgttgtaagtgtttgtttgcaacctttccatatagatgccttgaagaagttgttttatgaggatatggagatgatcactagttccaaattgtga

SEQ ID NO: 245 - protein, 465 aa, Medicago truncatula
MVNIHIYRSYTVTPSEKTPTTTLSLSLCDQLKLPNHGYQLYLFTNKNHSSSSLISSTNILITSLSKTLTHYYPFAGRLSWIKPQNHLLQLHCNNKGVQFLEATCDITLKDFGSFDSTHVVQKLVPKINYDVPVEDLPLLVVQFTKFPCGSLTLGLSMGRSVLDGSSAGSFISSWAKLAKGESLDSSLIPFLDKTLLDSKILHLPPRFHHHEFSPPPLWENSSNNSTHLSKNPLFATTMLKFTKKQVEKLKNKANNNENKVRGYTSFEVISGYLWRCVSKVRFEGNWNQPTRLTTLVNCRNRLNPPLPMNYFGNATFPTVTQTCSFDDVVNKPFCSVVGKVREAVKKVNDEYVRSVLDYVANQKDMNLLRDKFYNFAKRNGQFGGEPNLYVVGWTNFPFNESDFGWGKPDCMVPGIVNSDGIGKAYILDEANGDGFVVSVCLQPFHIDALKKLFYEDMEMITSSKL

SEQ ID NO: 246 - DNA, 1323 bp, Populus trichocarpa
atgaaaattgaaatcacatctagaaaatggatcactccatcatctccaactccaccccaccttcaaagcttgaaaatatcaagttttgaccagcatggtcagaatcattacgtgcctagcttccacttctacccggctaatgaagaagaatgtggcgtaatcagcaatgcagagaaaagtttgcggttacaggaatcattgtctgaggtcttaacgctatattatccattcgcaggaagatattcgagtgatgaacccttaattgaatgcaatgataagggagccgagtatttggaagcccaagtagctggctctctctctcagctcctcagcgatgaagagctcgagacccagttgcagaatcactttgttccaccaatgttcgatcctattagtagccctccgctagttgttcaattcaacaggtttgagtgtggtggaattgctataggtgtatctatgacacacaagatggtcgatgcattctcggcatttggattcattacggcatgggcaactgcgtgccgaatagggatcgacaaggcatgccctccaagtttcgaattgggttccattttcccaccaagagatgcatttagaatcgagaattgggaacgtaaagctacagctacaaataagattgtcacaaaaaggtttgtgtttgatgctgtagcaatatcaaatttgaaagctgctgttagtgccagcgctagaaataacagttcagagttgccgaaacaacaaatcacaagagtaaaggctgtggcggcactcatatgggggagttgtattagggtgtctcaagctgtacatggccgaatgagaccttccatcatcaaatttcctatcaatctgcgaggaaagacaaatcttcctataccagagaactcttgtggaaactttgcaggttggtcagctccccattttatgcccaatgatgagggcgagttgaaaattcacgagttagtaagtcggatccatgatggcattgaacaaactctcacaaattacgcgaaagcttcaagttctgatgaattttttatcatggtgatgaacgactttcgaaagctagatgaagcattgaagcaaactgaacaacaagatgtctatttgttttcttgctggtgtcggttccctatgtatgaagcagattttggttggggaaagcccagtttggtgagtagaggtgtgcaggctcacaaagagatgattttgctttttgacacgaaagatggtaatggaattgacgcgtgggtgagcttggaagaaaacaacatgcttctttttaaacaagatcctgatcttttagctttcactacctaa

SEQ ID NO: 247 - protein, 440 aa, Populus trichocarpa
MKIEITSRKWITPSSPTPPHLQSLKISSFDQHGQNHYVPSFHFYPANEEECGVISNAEKSLRLQESLSEVLTLYYPFAGRYSSDEPLIECNDKGAEYLEAQVAGSLSQLLSDEELETQLQNHFVPPMFDPISSPPLVVQFNRFECGGIAIGVSMTHKMVDAFSAFGFITAWATACRIGIDKACPPSFELGSIFPPRDAFRIENWERKATATNKIVTKRFVFDAVAISNLKAAVSASARNNSSELPKQQITRVKAVAALIWGSCIRVSQAVHGRMRPSIIKFPINLRGKTNLPIPENSCGNFAGWSAPHFMPNDEGELKIHELVSRIHDGIEQTLTNYAKASSSDEFFIMVMNDFRKLDEALKQTEQQDVYLFSCWCRFPMYEADFGWGKPSLVSRGVQAHKEMILLFDTKDGNGIDAWVSLEENNMLLFKQDPDLLAFTT

SEQ ID NO: 248 - DNA, 1296 bp, Populus trichocarpa
atgataatcaacgtgaaggagtcaaccatggtgcagccggcggaggagacgccccggagggggctgtggaattctaatgtggacttggtggtaccaaggttccacaccccaagtgtctatttttataggcccacaggtgctccaaacttctttgatgcaaaagtgctcaaaggggctttgagtaaggcccttgtgccattctaccccatggcaggacggttacgtagagatgaggatggtcgcattgaaattaattgcaatgctgagggagtgttgtttgttgaggctgagaccacctcagttatagatgattttgctgattttgcacccactttggagctcaagcagctcatacctactgtggattactctggcgggatatctacctatcctcttttggttctgcaggtgacttatttcaaatgcggaggagtttcacttggtgttggtatgcaacaccatgcagcggatgggttttctggtcttcacttcgtgaacacatggtcagatatggctcgtggacttgaccttaccattccacccttcattgacaggacccttctccgtgccagagatccacctcaacctgtattccaccacgttgagtaccagcctccaccgtccatgaaaaccgttcttgaaacctcaaaaccagagagcacggcggtctccatttttaagttgtctagggatcagctcagcaccctcaaagccaaagcaaaggaagatggaaacaatattagttatagttcatatgagatgttggcggctcatgtgtggagatcaacatgcaaagcacgtgaacttcctgatgatcaagagaccaagttatatattgccacagatggtcggtcaagatggcaacctcaactccctcctggttactttggcaatgtgatctttacagcaacaccaattgctgtagctggtgaaatgcaatcaaagccaacatggtatgctgcaggaaaaattcatgatgcattggttcgcatggataacgattatttaaagtcagcccttgattatctagagcttcagcctgacttgtcagcccttgttcgtggtgcccatagtttccggtgcccaaatcttgggattactagctgggttagactgccaatccacgatgcagattttggctggggcagacccatattcatggggcctggtgggatcgcatacgagggcttatcattcatcctacccagcccaacaaatgatgggagcatgtcagtagccatatctttgcaagctcaacatatgaaactatttgagaagttcatatatgacatttaa

SEQ ID NO: 249 - protein, 431 aa, Populus trichocarpa
MIINVKESTMVQPAEETPRRGLWNSNVDLVVPRFHTPSVYFYRPTGAPNFFDAKVLKGALSKALVPFYPMAGRLRRDEDGRIEINCNAEGVLFVEAETTSVIDDFADFAPTLELKQLIPTVDYSGGISTYPLLVLQVTYFKCGGVSLGVGMQHHAADGFSGLHFVNTWSDMARGLDLTIPPFIDRTLLRARDPPQPVFHHVEYQPPPSMKTVLETSKPESTAVSIFKLSRDQLSTLKAKAKEDGNNISYSSYEMLAAHVWRSTCKARELPDDQETKLYIATDGRSRWQPQLPPGYFGNVIFTATPIAVAGEMQSKPTWYAAGKIHDALVRMDNDYLKSALDYLELQPDLSALVRGAHSFRCPNLGITSWVRLPIHDADFGWGRPIFMGPGGIAYEGLSFILPSPTNDGSMSVAISLQAQHMKLFEKFIYDI

SEQ ID NO: 250 - DNA, 1326 bp, Populus trichocarpa
atgtctgtgcctatgagaatcgagatcatgcagagagaaaccatcaaaccatcctctccaacgccccttcacttaagaagtctcaagctctctcttctggaccaattcatgccagtaggtcacattcccctgcagctattttaccccaggaatggaaacgacacagatcaccttgccaaagccacggaaaggtcactgctactaaagacctcactgtctgaagccttgactcatttttatccattcgcaggcagactcaaagacaattcgtccattgaatgtgatgaccatggggctgaatatattgaggctcgaatccattgtattctctctgatattctcaaaaaacctgatactgaagtgctaaaacaactcatgcctgcagctgtaagtgaaccagccacggccagggatagtcaattaattgtccaagctagtttctttgattgtggtggcttggcaattggcgtgaatctttctcacaaggttgcagatgcagccacgctaacatcattcatcaagtgctgggctgcaaccgctcgcaggtcgagtactgaggtggtgatcagtccagtgttcatgggtgcttctattttcccacaaatggatttaccaatctcaatgcttccagtagatttgattcaaggagagtctgtcatgaaaaggtttgtgtttgaagctcccaaaattactgctctcaaggctaaagccatcagtgcaagcgtgccagatccaacacgggtggaatctgtaacagcgttgatctggaaatgtgcgatgagcgcatcaagatcaaacttgggggttcctagaaaagctgtgttgtctcttggcgtgaatattcggaagaggcttgtgccaaccttaccagacaactacggtgggaactacgtaggtagtatatcagcgcggatagaggatcatgatgatttagaattgcaaggtatagtgagccgtataaggaaagatcttatagagtttggtgaaaattatgctaaaataacccaaggggacgatacttcgttagcaatttgcaaggcggtagaagagtttggaaagatggccatgagcaaagatattgactcctataacggcaccagttggtgtagatttgaactttatgatgctgatttcggatggggaaaaccaacatggttgagcaatgttttcactatagagctgaaaaatattatgtgtttgatcgacacaagggatggtgatggaatagaagcgtgtataagtttgagtcgagaagacatggccttgttcgaatccaacaaggagctgcttgaatttgctgctgcaaatcctagtgtatcagtttag

SEQ ID NO: 251 - protein, 441 aa, Populus trichocarpa
MSVPMRIEIMQRETIKPSSPTPLHLRSLKLSLLDQFMPVGHIPLQLFYPRNGNDTDHLAKATERSLLLKTSLSEALTHFYPFAGRLKDNSSIECDDHGAEYIEARIHCILSDILKKPDTEVLKQLMPAAVSEPATARDSQLIVQASFFDCGGLAIGVNLSHKVADAATLTSFIKCWAATARRSSTEVVISPVFMGASIFPQMDLPISMLPVDLIQGESVMKRFVFEAPKITALKAKAISASVPDPTRVESVTALIWKCAMSASRSNLGVPRKAVLSLGVNIRKRLVPTLPDNYGGNYVGSISARIEDHDDLELQGIVSRIRKDLIEFGENYAKITQGDDTSLAICKAVEEFGKMAMSKDIDSYNGTSWCRFELYDADFGWGKPTWLSNVFTIELKNIMCLIDTRDGDGIEACISLSREDMALFESNKELLEFAAANPSVSV

SEQ ID NO: 252 - DNA, 1338 bp, Populus trichocarpa
atgcagatggtaagagttgaaattcgaacaaaacagtcaactattgtgcgacctgccgaagacacaccaaaaaaaagcatatggagctcaaatctggacctcttggtgccaattgtacacgtcccaacaatatacttctacaagccagttaatgattcttccagtttttttaaccctcaagtgctcaaggaggctcttagcaaggctcttgtgccattctaccatatggcagggaggttagagaaggatgaaaatggtagaatgtcgatattgtgtaactccaaaggggttttatttgtcgaggctgaaacaagatctaccattgatgaattgggggattttactccccactttgagatgctgcagttcattccagaagttgatcgttcaaacatattttcctatcctctactactgttacaggcaaccttgttcaaatgtggaggagtatgtcttggagttggcttacaccatatcttaggagatggaacttctgcaatccattttatcaactcatggtctgaaatagcaagaggactatctgttaccatcccaccgttcattgaccgtaccttgcttgatgctcgagttcctcctttccctgctatgcatcacgtagaatacgacccccctcctaccttgaacacccataactccggtgaccaaaccctagaaatccaatcaaatccgaaacccacttgtgcaaaaatcctcaccatcacatttgatcaactccggaccctaaaaaacaagtctagaaaaggcgttgttgatggcactatcaactatagcacctttgaaaccctagcagcacatatttggcaatgcacctgcaaggcacgtggaatctcgaacgaccaagcaacaaaattacacattccaacagatgggcgatctagattgaacccaccattgccagctggatactgtggcaatgctcttttcacaacagcagttttaggtttatcaggcgaaatccaatcaaagccattggtgcataccataacaaaaatccgtggagcattgaaaagaatggacaatgaatatttgagatcagccattgattatttgcatgtccagcctaatttagaagctttgaagcgagggccacacacatttaagaatccaaacctcaatattgtgagttggatgacaatgccgatatatgatgctgattttggttggggtcgaccttattttatggggccagcaattgttggcttcgagggcatggcttacattgctcgatgcccaaataatgatgggagcttaatgatatttacctgcttagaaagcaatcacatggaactcttcaagaagtccttttacgatttctaa

SEQ ID NO: 253 - protein, 445 aa, Populus trichocarpa
MQMVRVEIRTKQSTIVRPAEDTPKKSIWSSNLDLLVPIVHVPTIYFYKPVNDSSSFFNPQVLKEALSKALVPFYHMAGRLEKDENGRMSILCNSKGVLFVEAETRSTIDELGDFTPHFEMLQFIPEVDRSNIFSYPLLLLQATLFKCGGVCLGVGLHHILGDGTSAIHFINSWSEIARGLSVTIPPFIDRTLLDARVPPFPAMHHVEYDPPPTLNTHNSGDQTLEIQSNPKPTCAKILTITFDQLRTLKNKSRKGVVDGTINYSTFETLAAHIWQCTCKARGISNDQATKLHIPTDGRSRLNPPLPAGYCGNALFTTAVLGLSGEIQSKPLVHTITKIRGALKRMDNEYLRSAIDYLHVQPNLEALKRGPHTFKNPNLNIVSWMTMPIYDADFGWGRPYFMGPAIVGFEGMAYIARCPNNDGSLMIFTCLESNHMELFKKSFYDF

SEQ ID NO: 254 - DNA, 1323 bp, Populus trichocarpa
atggaaggaacgggaaaacatggaggtgaccagctttcagttaagaagtcagaacccgttctaatagaacctgaaacaaggactcatagtgggttttttttcttatgcaatcttgatcacatggtcactcattccgtggaaacagtgtacttctacaaggcaaagaaatggggaggcagtcgtgacaccctcagtgacacatttaaacaatctctggccaagattctggtgcattattaccctctcgcagggagattaagattaggatctgatgggaagtataatgtggagtgtaccaatgaaggggtgttgtttgtggaagcaagagcaaattgtaacatggatcaagttgacgttaaagtaattattgatgatcattctgaaacagcagggaagcttgtctatggatctccagatcctgagaacatactggaaaaccctctaatgactgcacaggttacaaggttcaggtgtggaggttttgctttgggattatcaattagccacttaatagctgatgggctatcagcaatggagtttatcaaatcatggtctgaaacagccagagggatgccgttaaccactaaaccagttcttgatagatcaattttgaggtctagacaacctcctaaaattgattttcatttcgaccagtacgctcctgcagaaaccagtaacgtatcaaacatatcaaatccatttcaaggagagcagattctgacgaaatgcttcctgtttgattccaacaagcttgcaatactgaagagcatggcaatggaggacggaaccatcaaaagctgctcaaacttcacagcgctcacagcttttgtgtggcgtgctcgctgcaaggcactgcagatgaatcctgatcaaacaactccacttctgttagtagtcgacgttcgatccaagcttaatccaccacttcccaaaggatactttggcaacggaattgtcttaatcacttgccctgggagggcaggagaattgattaaaaacacactatcttttgcagtggaagaagtgcagaatggaataaaaatggtgaatgaggagtttgtcaggtcttggattgattaccttgaagtgatgggagcaaaggactttcctttacactcctattttaaagtttcttcatggacaagactttcaattgagtgttcagactttggatggggagagccagcacagtttgcttgcacaaacttgcctaaaaattcagcttttttcctaccagatggaaaagaaaagaagggcattaatttgattttggatttgccagttactgccatgagcaccttccaggagctaatgcttctgtaa

SEQ ID NO: 255 - protein, 440 aa, Populus trichocarpa
MEGTGKHGGDQLSVKKSEPVLIEPETRTHSGFFFLCNLDHMVTHSVETVYFYKAKKWGGSRDTLSDTFKQSLAKILVHYYPLAGRLRLGSDGKYNVECTNEGVLFVEARANCNMDQVDVKVIIDDHSETAGKLVYGSPDPENILENPLMTAQVTRFRCGGFALGLSISHLIADGLSAMEFIKSWSETARGMPLTTKPVLDRSILRSRQPPKIDFHFDQYAPAETSNVSNISNPFQGEQILTKCFLFDSNKLAILKSMAMEDGTIKSCSNFTALTAFVWRARCKALQMNPDQTTPLLLVVDVRSKLNPPLPKGYFGNGIVLITCPGRAGELIKNTLSFAVEEVQNGIKMVNEEFVRSWIDYLEVMGAKDFPLHSYFKVSSWTRLSIECSDFGWGEPAQFACTNLPKNSAFFLPDGKEKKGINLILDLPVTAMSTFQELMLL

SEQ ID NO: 256 - DNA, 1353 bp, Populus trichocarpa
atgaaaatttacttgtcactttgctcttatatagtgaaacctgccaaaccaacatggaccggccgcgtttccctttctgagttggatcaaattggaacaataacgtatgttcccactatctacttctacaaaccatcgccaaactggctaacaccatccaatgatgtcgtcaatgaccttaaagattcattgagagatgttttggtgccattttatctactagctggccgtttacactggataggtcgtggccgcctcgagcttgagtgcaatgccatgggtgttatgttcactgaggctgaatctgaatccaagcttgaagatcttggcgacttcctaccgtcttcagagtacaaatacctaatcccaaatgttgactataccgttccaatacatgacttgcctctattattagtgcaactcaccaagttccaatgtggtggtattagcctaagtttaacaatatctcatgctgttgttgatgggcaaagtgctcttcactttatgtcagagtgggcaagaatcgcccgtggcgagccattaggcgtggttccttttcttgaccgaaaggtcttgcgagctagggatcctccaatagcttcacagtttcaccatgcggagtttgatcttccaccattactattggggcagttgaataacgctgaagagagaaaaaagaaggcaactgtagccatgttgaggctaaccaaagttcaggttgaaaatttaaagaatgtggcaaatgaggaaagaatcagtacagatagtggtcgtggttatactagatatgagaccttgtctggacatgtttggaggtctgtttgtaaggctcgtggacacaacccagagcagccaactgctctaggtgtttgtgttgattcacgtaaacggatgcagtcacctttgcctgatggttaccttggcaatgctactcttaatgtgatcgcggttagtcacgccggtgagctcatgtcaaagcccttgggatatgccgcaagaaagataagggaagcaattgaaacgatgacaaatgcgtatgtgagatctgcgattgatttcttgaagaatcaaccaaacttgacaaggtttcaagacattcacgcactaggaggcactgaagggcccttctacgggaacccaaatatcggggtggttagttggttaaccctacctatttatggccttgattttgggtggggaaaggagatttatatgggtccaggaactcatgattttgatggggactcattgcttctgccaagtcctaatggagacgggtctgtaatattagcaatatgtttgcaggtggctcatatggaagcttttaagaaatacttctatgaagatatataa

SEQ ID NO: 257 - protein, 450 aa, Populus trichocarpa
MKIYLSLCSYIVKPAKPTWTGRVSLSELDQIGTITYVPTIYFYKPSPNWLTPSNDVVNDLKDSLRDVLVPFYLLAGRLHWIGRGRLELECNAMGVMFTEAESESKLEDLGDFLPSSEYKYLIPNVDYTVPIHDLPLLLVQLTKFQCGGISLSLTISHAVVDGQSALHFMSEWARIARGEPLGVVPFLDRKVLRARDPPIASQFHHAEFDLPPLLLGQLNNAEERKKKATVAMLRLTKVQVENLKNVANEERISTDSGRGYTRYETLSGHVWRSVCKARGHNPEQPTALGVCVDSRKRMQSPLPDGYLGNATLNVIAVSHAGELMSKPLGYAARKIREAIETMTNAYVRSAIDFLKNQPNLTRFQDIHALGGTEGPFYGNPNIGVVSWLTLPIYGLDFGWGKEIYMGPGTHDFDGDSLLLPSPNGDGSVILAICLQVAHMEAFKKYFYEDI

SEQ ID NO: 258 - DNA, 1281 bp, Ptelea trifoliata
atggatctccaaatcacctgcaccgaaatcatcaagccttcttcgccgacgcctcaacaccaaagtagctataaactttcaattattgatcagttaactcctaatgtttacttttccatcattctcttgtattcaaaagccggtgaaagtaccaccaaaacttcagatcacctcaaaaaatctctttcaaatacagtaacccactactatcctttagctgggcaactcaaatatgatcaacttattgttgattgtaacgaccaaggtgtcccgttcatcgaagcacacgtcgccaacgacatgcgtcagctttttaaaataccaaatattgatgttcttgaacaactcctaccattcaaaccgcatgaagggtttgattctgatcgttccaacttaaccgttcaggtcaattactttggttgtggaggaatggcgattggtctttgcttcagacacaaagttattgatgcaacaacggctgcattctttgttaagaactggggtgtaattgctcgtggtgctggagaaattaaggacgtgatcattgatcatgcttccctgtttcccgcaagagatttatcttgcttggcaaagagtgttgacgaagagtttttgaagccagagtctgaaacaaagcggtttgtgtttgatggtcctactatagcttctttacaagaaacgtttacaagttttgaacgacgtccaacacgctttgaggttgtgtcagcagttattttgggtgctttgataactgcaaccagagaatctgatgatgagtctaacgttcctgaacgtttggacaccataatttcagtgaatctacggcagagaatgaatccaccattcccggagcattgcatggggaatataatatccgggggattagtgtattggccactggagaaaaaagttgattacgggtgtttagcaaaagagattcatgaatcaataaagaaagtggacgatcaatttgcgaggaagttctatggggacgcagagttcttgaacctgccgaggcttgcgggtgctgaggatgtgaagaagcgggagttttgggttactagttggtgcaaaactccgctgtatgaagctgatttcgggtggggaaagcctaagtgggcaggcaattccatgaggctcaatcagataactgttttctttgacagtagtgatggtgagggagttgaagcttgggtgggattgcccaaaaaagacatagctcgatttgaaaaagattctggcatccttgcttacacttcccctaatccaagcatattttga

SEQ ID NO: 259 - protein, 426 aa, Ptelea trifoliata
MDLQITCTEIIKPSSPTPQHQSSYKLSIIDQLTPNVYFSIILLYSKAGESTTKTSDHLKKSLSNTVTHYYPLAGQLKYDQLIVDCNDQGVPFIEAHVANDMRQLFKIPNIDVLEQLLPFKPHEGFDSDRSNLTVQVNYFGCGGMAIGLCFRHKVIDATTAAFFVKNWGVIARGAGEIKDVIIDHASLFPARDLSCLAKSVDEEFLKPESETKRFVFDGPTIASLQETFTSFERRPTRFEVVSAVILGALITATRESDDESNVPERLDTIISVNLRQRMNPPFPEHCMGNIISGGLVYWPLEKKVDYGCLAKEIHESIKKVDDQFARKFYGDAEFLNLPRLAGAEDVKKREFWVTSWCKTPLYEADFGWGKPKWAGNSMRLNQITVFFDSSDGEGVEAWVGLPKKDIARFEKDSGILAYTSPNPSIF

SEQ ID NO: 260 - DNA, 1275 bp, Phaseolus vulgaris
atgacgattacagtgaaggagtcgacaatggtgcaacccgcagagggtacaccacggaaggtgttgtggatctcaaacctggatttgttggcgagggattatcacagtcccaccgtctatttctacaaaccaaacggagcttccaatttcttccattccaacactctgaaagaagccctaagtaagactctcgtccttttctacccaatggccgcccgcctccgccacggagacgaccaccgcgtggagatttattgcgacggtcaaggtgcacttttcgttgaggctcatgccgccgtttccatggaccagttcactcacaactttcacaatcgcaaccttattccggcggtggattattctgccgggattgaaacatatccgttagtggtgttacaggtaacacatttcagatgtggaggggtctcattaggcgttggtatagagcaccgtttagcagatggagcatcaggtcttcacttcatcaattcatggtccgatgttgctcgtggcatccctatttctgttcccccatttattgacaggaacctacttcgtgccagggaccaacctcaaccggcttttcctcaccacgaataccagctctcgccacccatcaccaccaccaccaacacaactgcggttgcctctatttttaaattgagtcgtgagcaactcaacatcctcaagggcaagtcgaaagaagatggcaacacagtaaactttagcacttatgagatgttggcagctcatatatggagatgtttgagcaaagcaagaggccttcctgaagaccaagaaaccagactatatattccaactaatggaaggtcaaggctgcaacctcccctccctcctggttaccttggcaatgctatcttctccaccattcccaaagcatttgcaggagatctcgtgtcaaaacctacatggtatgctgcaaatcaaatccacaacgcattagcgagaatggacaacgaatatatgagatcagctcttgactatctgcagctacagcctgatctgaattctcttcttcctatagcacatacttctaggtatccaattgtgcgtatcaatagctgggctaagtttccaatctatgatgctgactttggttggggaagaccaatcttcatgagacctgcctggattgtacacgaggggcaatcgatgatacttccaagcccaacaaatgatggcaacttgtatttagtaatcaatctaccacctcaccatatgaagctgtttcaagaattcctttatgacatttga

SEQ ID NO: 261 - protein, 424 aa, Phaseolus vulgaris
MTITVKESTMVQPAEGTPRKVLWISNLDLLARDYHSPTVYFYKPNGASNFFHSNTLKEALSKTLVLFYPMAARLRHGDDHRVEIYCDGQGALFVEAHAAVSMDQFTHNFHNRNLIPAVDYSAGIETYPLVVLQVTHFRCGGVSLGVGIEHRLADGASGLHFINSWSDVARGIPISVPPFIDRNLLRARDQPQPAFPHHEYQLSPPITTTTNTTAVASIFKLSREQLNILKGKSKEDGNTVNFSTYEMLAAHIWRCLSKARGLPEDQETRLYIPTNGRSRLQPPLPPGYLGNAIFSTIPKAFAGDLVSKPTWYAANQIHNALARMDNEYMRSALDYLQLQPDLNSLLPIAHTSRYPIVRINSWAKFPIYDADFGWGRPIFMRPAWIVHEGQSMILPSPTNDGNLYLVINLPPHHMKLFQEFLYDI

SEQ ID NO: 262 - DNA, 1293 bp, Solanum lycopersicum
atgggaagtgaaaaaatgatgaaaattaatatcaaagaatcaacactagtgaaaccatcaaaaccaacaccaacaaagagaatttggagttctaatttggatttaattgttggaagaattcatcttttgactgtttatttttataaaccaaatggatcttcaaatttttttgataataaagttattaaagaagcattaagtaatgttttagtttcattttatccaatggctggaagattaggtagggatgaacaaggtagaattgaagttaattgtaatggtgaaggtgttttgtttgttgaggctgaaagtgattcatgtgttgatgattttggtgattttacaccatctttggaacttagaaaactcattccaagtgttgaaacctctggagatatctcaactttcccactagttatatttcagattactcgtttcaagtgtggcggagtcgctcttggtggtggagtattccacacgttatccgatggtctctcatccatccacttcatcaacacgtggtcggacatcgcccgtggcctctccgtcgcagtcccgccgttcatcgatcggacgctcctccgtgcaagggacccaccgacatcttctttcgagcacgttgagtaccatcctccacctaccctaaactcatcgaaaaatcgcgagtccagtaccacgaccatgttgaaattctcgagtgaacaactcgggcttcttaagtccaagtccaaaaatgagggtagcacctatgaaatcctcgcagcccatatttggcgatgcacgtgcaaggcacgtggattgccagaggatcaattgaccaaattacacgtggccaccgacggaaggtcaaggctttgccctcccttgccaccgggttacctaggaaacgtcgtgttcacggcaaccccaatagctaaatcatgcgaacttcaatcagagccgttgacaaattccgtcaagagaattcacaacgagttgatcaaaatggacgacaattacctaagatcagcactggattacctcgaattacaacctgatttatcaaccctaattcggggcccggcttactttgctagccctaacctcaatattaatagttggactaggttgcctgtccatgagtgtgattttggatggggtaggccaattcatatgggaccagcttgcattttatatgaagggacaatttatattataccaagtccaaattctaaagataggaacttgcgtttggctgtttgtctagatgctggtcacatgtcactatttgaaaaatatttatatgaattatga

SEQ ID NO: 263 - protein, 430 aa, Solanum lycopersicum
MGSEKMMKINIKESTLVKPSKPTPTKRIWSSNLDLIVGRIHLLTVYFYKPNGSSNFFDNKVIKEALSNVLVSFYPMAGRLGRDEQGRIEVNCNGEGVLFVEAESDSCVDDFGDFTPSLELRKLIPSVETSGDISTFPLVIFQITRFKCGGVALGGGVFHTLSDGLSSIHFINTWSDIARGLSVAVPPFIDRTLLRARDPPTSSFEHVEYHPPPTLNSSKNRESSTTTMLKFSSEQLGLLKSKSKNEGSTYEILAAHIWRCTCKARGLPEDQLTKLHVATDGRSRLCPPLPPGYLGNVVFTATPIAKSCELQSEPLTNSVKRIHNELIKMDDNYLRSALDYLELQPDLSTLIRGPAYFASPNLNINSWTRLPVHECDFGWGRPIHMGPACILYEGTIYIIPSPNSKDRNLRLAVCLDAGHMSLFEKYLYEL

SEQ ID NO: 264 - DNA, 1374 bp, Vitis vinifera
atggtgaaattgatggctacttacacggtgagaccagccaaggagacaccgggaggctacaggtgtttatcagacagtgatcaagttagagctctcactcacgcacccatcatctacttttacccacctgtaaatgtgtcccttgaatcggccatcgagattctgaggcactctctgagtgaggcattggtgattttctatccactagcgggatggttgcactggattggtggaggccgccttgtgctcgagtgcaatgccttgggggctctgctcattgcagtagagtccgatgccaaaatcgatgactttggagacttcggaccaacccaagagatccgagctcttatcccttctgtggattatgacaagccaatccatgaactaccattgcttttggtgcaagtcaccaaatttagctgtggtggcataagtctgggcttgggagcattgcatatcatgactgatggccttagtgcatcacacttcatctcggagtgggctaaaatcgcccgtggcgagcaacctaatagctcaccatttctggatcggtcaattttgctagccccggagcatttgagtgcaccagtgtttgatcatccagagtatagtcctcagcccctcttgattgggaagcaagatcacatggaagagcgaaagagagaaagcgctacactcacgttaaaattaagcaaagatcaagttgagaaactgaaggacaaagccaataaggatcggagtgcttccaacaacaagcgcccctacaccaggtatgaggctgttgctggacacatctggaggagtgcgtgcaaggcacgtcagcatgaaagccagcagccaacaacattgtctatcatcgttgatgctcgcaatcgcatggagccaccattgccacccagatatttcggaaatgctacttttcgggtaactgctgaaagcacgtcaggggagctagtctccaagccattaggctatgcttcaggtaaagcacgacaggcaatagagaaggcaacgcatgaatatttacaatcatctcttatgtatgtgaaatgtcaggaggatgtaactccgttcaggaatttcaacaccgttggatgcgccaaaggagctttctatgggaaccctaatcttgagatcactagctgggccagactgcccatttatggggcggatttcgggtggggcgaggaaatttacatgggtccaggagaaattggctacgatgggaaggttttcgtatttccgggccagggcctagacggatcattccttgttgcattgaggctgcaagtacgccacattgacgctttccagaaattcttcaacgaagatatttgtagtcaaaaaccactttcaattaatccttcattataa

SEQ ID NO: 265 - protein, 457 aa, Vitis vinifera
MVKLMATYTVRPAKETPGGYRCLSDSDQVRALTHAPIIYFYPPVNVSLESAIEILRHSLSEALVIFYPLAGWLHWIGGGRLVLECNALGALLIAVESDAKIDDFGDFGPTQEIRALIPSVDYDKPIHELPLLLVQVTKFSCGGISLGLGALHIMTDGLSASHFISEWAKIARGEQPNSSPFLDRSILLAPEHLSAPVFDHPEYSPQPLLIGKQDHMEERKRESATLTLKLSKDQVEKLKDKANKDRSASNNKRPYTRYEAVAGHIWRSACKARQHESQQPTTLSIIVDARNRMEPPLPPRYFGNATFRVTAESTSGELVSKPLGYASGKARQAIEKATHEYLQSSLMYVKCQEDVTPFRNFNTVGCAKGAFYGNPNLEITSWARLPIYGADFGWGEEIYMGPGEIGYDGKVFVFPGQGLDGSFLVALRLQVRHIDAFQKFFNEDICSQKPLSINPSL

SEQ ID NO: 266 - DNA, 1371 bp, Vitis vinifera
atggacttcgggaagtgctccaaaagtgcgaaagaagactgcagctgctgtcctctgttgaagacgacaatggaaatgaagattgatatcctttcaacacagcccatcaagccatcttctccaactccaaatcatctcagaagcttcaaaatctcgctattggatcaacttgctcctcccttttatgtccctgttatcctactcttctctgctgatgatttcgactgtgaagctgttgatcacgtcaccatatgtgatctgctgaagaggtctctctcccaaaccttaagccgcttctatcctttagctgggaagctcaaaggaaatgacagtgtggattgcagtgatgatggcgctgtgttcatggaggctcgagcaaacgttgagctctcagaaattctgagagacccggagatagatttgttgcagaagcttctcccatgtgaaccgtacagtgtgggatcagaatcatcagatagagcaatcacagccattcaagcaacaattttcgagtgtggcggaataggaattggagtatgcatgtcacacaaggtggccgatggggcaacgctggccactttcctcaccgcttggtctgcaacagcaatgggtacagatgatggcatcactccctttttggactcagcgtccctcttcccaccaagagatatcaatacggtactgtccagtggtgtgatcagccacggtaaaactctaacaaggagattcttatttgatgcagcaagcttagcccgcctgcagtccaaagcatccaattctacccgtgtagaagctgttacatctctgatatggaagtcagccatggatgtggccagagaaaaatcagggaaggacaccatatcatccattgtcacacatgtagtgaatctacgggggaagacagagccaccactgtcggatcgctctttaggaaacctatggcagcaagcagttgcaacagtaacggagcaggaaggcaaggtagagctggatgacttggtgggaaggctgagaagagcaataaaaaaggtagataaggagtatgtgaaggagattcaaggcgaagaagggctatcaaaggcttgtggagccatgaaagaagtccagaaaatgatcatgtccaagggagagatggagctgtacaggtttagcagttggagcagatttccattttatgaaactgattttgggtttgggaggcctatctgggtgtgcactattactgcgcctatcaagaatgtgatcattttgatggacacaaaatctgggggtggaatagaggcttgggtgacaatggttgaagaagacatgaccaaattccaacgccactatgagcttctggagttcgtttcatcaacacaaagtgcttaa

SEQ ID NO: 267 - protein, 456 aa, Vitis vinifera
MDFGKCSKSAKEDCSCCPLLKTTMEMKIDILSTQPIKPSSPTPNHLRSFKISLLDQLAPPFYVPVILLFSADDFDCEAVDHVTICDLLKRSLSQTLSRFYPLAGKLKGNDSVDCSDDGAVFMEARANVELSEILRDPEIDLLQKLLPCEPYSVGSESSDRAITAIQATIFECGGIGIGVCMSHKVADGATLATFLTAWSATAMGTDDGITPFLDSASLFPPRDINTVLSSGVISHGKTLTRRFLFDAASLARLQSKASNSTRVEAVTSLIWKSAMDVAREKSGKDTISSIVTHVVNLRGKTEPPLSDRSLGNLWQQAVATVTEQEGKVELDDLVGRLRRAIKKVDKEYVKEIQGEEGLSKACGAMKEVQKMIMSKGEMELYRFSSWSRFPFYETDFGFGRPIWVCTITAPIKNVIILMDTKSGGGIEAWVTMVEEDMTKFQRHYELLEFVSSTQSA

SEQ ID NO: 268 - DNA, 1353 bp, Selaginella moellendorffii
atgtccaatgtggttcatatagcctccgtctgcacgatcgtcccagcgattccaacgcgccagccttgtactctctggctttgcaactctcagatccagctcctgtccgagaactatctcaagcaagtctactatttcccagaagcagtggattcgtcaccaggctccttcgatcgattggttctcgttccatactacccaatagcggggaggccccggatcgccggtctcgaccgcccggttctcgagtgcaacaaccaaggcgtcgaatttgtggtggcatttgccaatgcgagcttccacgactggggcgattccatgaagcactgctcaatcgagcatgagctcaaccaggcacagaccgagatcacggatcacgagaacttcccacagctcaaagtcaccaagttccggtgtggcgggatcgccctcggcctcgtcaccacccacattgtcaccgacggctcgtccatctttgcgttcttcaaggcctggtcggatatccatcagggattgccaccgccgaatccaccgccatcattcgactccagcatcctcagggcccgagatccccccagcatcaagatgcccatccgggactacgtcgcggtggcaccgtccctggcccaggatcacactggaaagtccggggaggatatctctcccaaataccacgtccgggaattccacatgagcgagctccagctctcgcatctcaggcacgagatcgcatccggcccgttctcctacggcagcttcccgacatccttcgaggccgccgcggcgctcgtctggaaatccatcaccgaggcgcgggatctcgtcgacaccgccatcgccacattcgtctactcgggctccgccaaggccggcaagaaccggcggcatcccccaatcccggacgagtactgcggcacctccgccatgaccctcgtcctcccgtgtccggcgcgcgacctcaagaataagcacatctccttggccgctcgcctcgtccacgacgacatccgggccatcacccacgagcgattccaatccaccattgactggatggagctggaaggaatcggcggccccgggcgcaaggagatcgcggtcaacatgagggccgagatggcggtctactccgttgacctggtcaccttccccgtctacgacgttgactttgggtgggggcggcccgcccacttctcgctggtgctggagccgtggtatggcaacggggtggtggtgtttcttcccactgcccagggagggacgcgagagcgccgcattgtggtcatgctcctcgaggatgaaatgaagaggttgctgcgaagtgagctcctcgccaagttcgccaccttggaatga

SEQ ID NO: 269 - protein, 450 aa, Selaginella moellendorffii
MSNVVHIASVCTIVPAIPTRQPCTLWLCNSQIQLLSENYLKQVYYFPEAVDSSPGSFDRLVLVPYYPIAGRPRIAGLDRPVLECNNQGVEFVVAFANASFHDWGDSMKHCSIEHELNQAQTEITDHENFPQLKVTKFRCGGIALGLVTTHIVTDGSSIFAFFKAWSDIHQGLPPPNPPPSFDSSILRARDPPSIKMPIRDYVAVAPSLAQDHTGKSGEDISPKYHVREFHMSELQLSHLRHEIASGPFSYGSFPTSFEAAAALVWKSITEARDLVDTAIATFVYSGSAKAGKNRRHPPIPDEYCGTSAMTLVLPCPARDLKNKHISLAARLVHDDIRAITHERFQSTIDWMELEGIGGPGRKEIAVNMRAEMAVYSVDLVTFPVYDVDFGWGRPAHFSLVLEPWYGNGVVVFLPTAQGGTRERRIVVMLLEDEMKRLLRSELLAKFATLE

SEQ ID NO: 270 - DNA, 1305 bp, Physcomitrella patens
atgagaattgagaggcggtttcggcgggtggtgaagccagctgataggagcaatgcggtaccgaaggtggtgccgttgagcagttcggatgtggtggtgcccaaggtgcacgtcgaagtgatttatgcatatgaggccagcaagggggtcagctttgacaacgtcgtccaggtgttggaagaggcgctagggcgggtgctaaccgagtacagagagtgggctggacgcctcgtgattaacgagacaggcagacctgccattgagctgaatgacgacggagtagtgtttgtggaagcggtggcggacgggtgcttgcaagatgttttcccgtttgatccctcgcctttgcttctaagtatggtacctcctagtcgtggtgtaccagagcttctgcttgttcaggtcaccaagtacaagtgcggtggattgacgttgggtgtagcaaggcatcaccaagttgcggacggaacgtcggcgagccaatttatgaacgcgtgggcgtctgcgtgcaaagggatcccgccctcgcccatactccacgatcgtgcagctctgatgcccagggaccagccaatgccaacattcgaccatatcgagtatgttatgcccctgcctaagcctgttgctaaggacacatttaacaaccgtcctctcgcaagaaagaaaatacgctttagtttcgacatggttcaaaaaatcaagtcgaaagccgttaaagagaacgacgagcgcggcttccccacctactccaccttcgagagcctgacagggcacttgtggcggtgtataacgaaggcgcgtggattgagcagtgacatcgagacacggactaccgtcgcctgcgacgcgaggcgccgactgaccccctcaatctcagaagattactatggcaatgttatcttccacagttgcgctcggacccttgtgtcacaagtgacggaggaacccctctcgtacgctgcaggtgttgtacacgcttccatcaaaagacttgataacgattacatccgatcagcaatcgactacatcgagcaccggcgccagaatactgcttcctatggcagaaccttgagcacggtattgagccctgacctgagccttacttcttggttacagatgccgctctacaaattggacttcggatggggcacgcctgtgtatgccggccctccctacgtcccttttgaagggctcatcatcctcaacgcttctcacactcaagatggcagtgttgatgccatcctcgcattgttcgaggacgacatggccaagttcgaaaacatctgcttcgaagtcccgaattag

SEQ ID NO: 271 - protein, 434 aa, Physcomitrella patens
MRIERRFRRVVKPADRSNAVPKVVPLSSSDVVVPKVHVEVIYAYEASKGVSFDNVVQVLEEALGRVLTEYREWAGRLVINETGRPAIELNDDGVVFVEAVADGCLQDVFPFDPSPLLLSMVPPSRGVPELLLVQVTKYKCGGLTLGVARHHQVADGTSASQFMNAWASACKGIPPSPILHDRAALMPRDQPMPTFDHIEYVMPLPKPVAKDTFNNRPLARKKIRFSFDMVQKIKSKAVKENDERGFPTYSTFESLTGHLWRCITKARGLSSDIETRTTVACDARRRLTPSISEDYYGNVIFHSCARTLVSQVTEEPLSYAAGVVHASIKRLDNDYIRSAIDYIEHRRQNTASYGRTLSTVLSPDLSLTSWLQMPLYKLDFGWGTPVYAGPPYVPFEGLIILNASHTQDGSVDAILALFEDDMAKFENICFEVPN

SEQ ID NO: 272 - DNA, 56 bp, Artificial sequence
  Primer forward
ggggacaagtttgtacaaaaaagcaggcttaaacaatgggttcattgccaaattta

SEQ ID NO: 273 - DNA, 50 bp, Artificial sequence
  Primer reverse
ggggaccactttgtacaagaaagctgggtcacaacacaattccaccaact

SEQ ID NO: 274 - protein, 29 aa, Artificial sequence
  motif 18 a
  VARIANT (7)..(7): / replace = "Ala"
  VARIANT (8)..(8): / replace = "Ile"
  VARIANT (10)..(10): / replace = "Val"
  VARIANT (11)..(11): / replace = "Gly"
  VARIANT (13)..(13): / replace = "Ser"
  VARIANT (16)..(16): / replace = "Val"
  VARIANT (17)..(17): / replace = "Ala"
  VARIANT (19)..(19): / replace = "Ala"
  VARIANT (28)..(28): / replace = "Ala"
FKCGGLSLGLSWAHILGDGFSASHFINSW

SEQ ID NO: 275 - protein, 41 aa, Artificial sequence
  motif 18 b
FKCGGLSVGLSWAHILGDAFSAFNFITKWSHILAGQSQPKS

SEQ ID NO: 276 - protein, 21 aa, Artificial sequence
  motif 19 a
  VARIANT (4)..(4): / replace = "Leu"
  VARIANT (6)..(6): / replace = "Val" / replace = "Leu"
  VARIANT (13)..(13): / replace = "Ala"
  VARIANT (14)..(14): / replace = "Leu"
  VARIANT (15)..(15): / replace = "Ile"
  VARIANT (16)..(16): / replace = "Ile"
  VARIANT (20)..(20): / replace = "Ala"
SGRPEIKCNDEGVRFVEAECD

SEQ ID NO: 277 - protein, 22 aa, Artificial sequence
  motif 19 b
SGRPFIKCNDAGVRIAESQCDK

SEQ ID NO: 278 - protein, 21 aa, Artificial sequence
  motif 20 a
  UNSURE (1)..(1): Xaa can be any naturally occurring amino acid
  VARIANT (3)..(3): / replace = "Thr"
  VARIANT (4)..(4): / replace = "Arg"
  VARIANT (5)..(5): / replace = "Tyr"
  VARIANT (7)..(7): / replace = "Ile"
  VARIANT (9)..(9): / replace = "Ser" / replace = "Thr"
  VARIANT (10)..(10): / replace = "Gly"
  VARIANT (11)..(11): / replace = "Leu"
  VARIANT (12)..(12): / replace = "Val"
  VARIANT (14)..(14): / replace = "Lys"
  VARIANT (15)..(15): / replace = "Ser"
  VARIANT (17)..(17): / replace = "Cys"
XYSTFEALAAHIWRCIAKARG

SEQ ID NO: 279 - protein, 21 aa, Artificial sequence
  motif 20 b
DTKYFEIISATIWKCIAQIRG

SEQ ID NO: 280 - protein, 34 aa, Artificial sequence
  motif 21 a
  VARIANT (3)..(3): / replace = "Phe"
  UNSURE (5)..(5): Xaa can be any naturallly occurring amino acid
  VARIANT (11)..(11): / replace = "Met"
  VARIANT (12)..(12): / replace = "Ala"
  VARIANT (13)..(13): / replace = "Ile" / replace = "Val"
  VARIANT (17)..(17): / replace = "Cys"
  VARIANT (20)..(20): / replace = "Val" / replace = "Leu"
  VARIANT (24)..(24): / replace = "Pro" / replace = "Val"
  VARIANT (28)..(28): / replace = "Thr"
  VARIANT (31)..(31): / replace = "Ile" / replace = "Met"
  VARIANT (32)..(32): / replace = "Lys"
VQVTXFKCGGLSLGLSWAHILGDAFSASTFFNKW

SEQ ID NO: 281 - protein, 36 aa, Artificial sequence
  motif 21 b
VFVKFTSFKCGGLSVGLSWAHILGDAFSAFNFITKW

SEQ ID NO: 282 - protein, 23 aa, Artificial sequence
  motif 22 a
  VARIANT (1)..(1): / replace = "Ala"
  VARIANT (5)..(5): / replace = "Trp"
  VARIANT (6)..(6): / replace = "Phe"
  VARIANT (7)..(7): / replace = "Val"
  VARIANT (12)..(12): / replace = "Cys"
  VARIANT (20)..(20): / replace = "His" / replace = "Arg"
ESGRPYIKCNDAGVRIVEAKCDK

SEQ ID NO: 283 - protein, 23 aa, Artificial sequence
  motif 22 b
KSGRPFIKCNDAGVRIAESQCDK

SEQ ID NO: 284 - protein, 29 aa, Artificial sequence
  motif 23 a
  VARIANT (3)..(3): / replace = "Thr"
  VARIANT (4)..(4): / replace = "Glu"
  VARIANT (5)..(5): / replace = "Pro"
  VARIANT (6)..(6): / replace = "Asn"
  UNSURE (8)..(8): Xaa can be any naturally occurring amino acid
  VARIANT (9)..(9): / replace = "Tyr"
  VARIANT (11)..(11): / replace = "Pro"
  VARIANT (12)..(12): / replace = "Thr"
  UNSURE (13)..(13): Xaa can be any naturally occurring amino acid
  VARIANT (14)..(14): / replace = "Met"
  VARIANT (23)..(23): / replace = "Val" / replace = "Ile"
  VARIANT (25)..(25): / replace = "Ala"
  VARIANT (28)..(28): / replace = "Tyr"
  VARIANT (29)..(29): / replace = "Tyr"
SRVGEGKXHELSXLDLAMKLHYLRGVYFF

SEQ ID NO: 285 - protein, 16 aa, Artificial sequence
  motif 23 b
GEHNLNYMDLLMKLHY

SEQ ID NO: 286 - protein, 29 aa, Artificial sequence
  motif 24
  VARIANT (6)..(6): / replace = "Ile" / replace = "Phe"
  VARIANT (7)..(7): / replace = "Ala"
  VARIANT (8)..(8): / replace = "Ile"
  VARIANT (10)..(10): / replace = "Leu"
  VARIANT (12)..(12): / replace = "Ile"
  UNSURE (15)..(15): Xaa can be any naturally occurring amino acid
  VARIANT (16)..(16): / replace = "Leu" / replace = "Met"
  UNSURE (20)..(20): Xaa can be any naturally occurring amino acid
  VARIANT (27)..(27): / replace = "Ser"
  VARIANT (28)..(28): / replace = "Ala" / replace = "Thr"
FKCGGVSLGVGMSHXVADGXSALHFINSW

SEQ ID NO: 287 - protein, 29 aa, Artificial sequence
  motif 25
  VARIANT (6)..(6): / replace = "Val"
  VARIANT (7)..(7): / replace = "Val"
  VARIANT (11)..(11): / replace = "Thr"
  VARIANT (12)..(12): / replace = "Phe"
  VARIANT (14)..(14): / replace = "Leu" / replace = "Phe"
  VARIANT (15)..(15): / replace = "His"
  VARIANT (16)..(16): / replace = "Glu"
  VARIANT (23)..(23): / replace = "Arg"
  VARIANT (26)..(26): / replace = "Tyr"
NPNLLITSWTRLPIYDADFGWGKPIFMGP

SEQ ID NO: 288 - protein, 15 aa, Artificial sequence
  motif 26
  VARIANT (1)..(1): / replace = "Ala"
  VARIANT (4)..(4): / replace = "Glu"
  VARIANT (5)..(5): / replace = "Thr"
  VARIANT (7)..(7): / replace = "Thr"
  VARIANT (8)..(8): / replace = "Pro"
  VARIANT (9)..(9): / replace = "Tyr"
  VARIANT (12)..(12): / replace = "Leu"
SLSKVLVHFYPMAGR

SEQ ID NO: 289 - DNA, 2194 bp, Oryza sativa; identical to SEQ ID NO: 156

SEQ ID NO: 290 - DNA, 4107 bp, Artificial sequence
  expression cassette
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatgggttcattgccaaatttagaagcacctcctccttcaagttcaagaatttcaaccgttgttccagcaacaccacgatgtgaagaaaaaggtgaacacaacctaaactacatggacttgttgatgaagcttcactatgtccggtccatttatttcttcgattctgaagctgttcaaggccttacaatatccgatttaaaaacaccgatgtttccactgctggatttgtactcgcatgttgccggtcgagttagaatagccaaatccggcagaccgtttatcaaatgcaatgatgccggtgtgcgaatcgcggagtcgcagtgtgataaaacgctgagggaatggttggatgaaaatgagtattcagttgatgaacttgttcatgatcatgtgcttggtcctgatcttgctttttctcctttggtttttgtcaagttcacgagtttcaaatgtgggggactctctgttggactaagttgggctcacatccttggagatgcattttcagcttttaatttcatcaccaaatggagtcacatactagctggtcaatcccaaccaaaatctcttcacattccaaatcttgtcaaacctcaattcctatccaattttgtttttgataatcctatttccatcaaaaatgaaaatgttgttggggaatattggcttgctgcaaatgattgttatgtccctagtcacacatttcacatcacttctagccaacttcaccatttggtaaaaacaaccaaatctattaccaataccgatactaagtattttgaaattatttcagctacgatatggaaatgtatagcacaaataagaggtgacattggaccaaaggttgtgacaatatgtagtaaaaataaaaatacctctaaatgtgctgaaaatgaattcccaacaaatgacatattgttgagcaaaatcgaaacaaatttgcgcccggaggaatataatatattagatttaatgaatctgattggtgagaaaaaaattaatgagaattatgcattggaaaaattggtggagaaaggtgatggaaaagatgatttttttgtatatggagcaaagttaacatttgtagacttggaagaagctgatttatatggtgtaaagcttaatggaaagaaacctattagggcgaattgtgatttacgtggtgtcggtgatcaaggagttgttttggtttttccaggtccagaagatgatgatggtaacaatggaagaatgataaaagtttcattgccagggaaagaacttgaccagttgaaatataagcttgaaagagaatggggtatacaacattatgcaagtctaacattttaattcttgtacaaagtggtgatatcacaagcccgggcggtcttctagggataacagggtaattatatccctctagatcacaagcccgggcggtcttctacgatgattgagtaataatgtgtcacgcatcaccatgggtggcagtgtcagtgtgagcaatgacctgaatgaacaattgaaatgaaaagaaaaaaagtactccatctgttccaaattaaaattcattttaaccttttaataggtttatacaataattgatatatgttttctgtatatgtctaatttgttatcatccgggcggtcttctagggataacagggtaattatatccctctagacaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaac

SEQ ID NO: 291 - DNA, 999 bp, Populus trichocarpa
atggagatcccagtgatcaatagaataagcgatttcgagacaggcttagcctctctgcaaaacccaacatttctttcccagattcttgcactttctggtgtcgaaaaaattcaccaagcttatagtttttggaaatggggcgctctgattcttgccctggccgcctctttcacagccataattaatagaatcaagattctcatcatccgattcaaaaaccaccccttcatctcttcaccatctcttattagcaatcaagaagattgtgattacgaaagcgaaacagacttatcttgctcatcatcaatatccttatcagatgacgaacaggaagaagagtccacatcatcttcaagaagttggtggtccattaatgatcatgatcaagacttccgggttagaggctctgggaatcgttacattgacgatcaatgccagggtggtaattttaggctccggagacgacgaaacagcagcattggagactttttttcgttgactgatttcacaaacgggaaaaacgttgtaaagctttgggataatttaggattaagtctaggattaaaccttaacaacagctgcgattcgagaaacgctgccgtttctttttatgacattaacaaggagcagaagatatgttccatatttggcagcacatgtgatagtattttcgcggctgtttccacatctccttcggtggttgtctcggcagagacaaatttgtcgggtcattcatcgttgagtttatgggacacccgagttgggtttcgggtgccggaggtttttgcggaattaaggcctacgttggggaagattgtgggtgtcgtcgtcggcggcgtagagaaggtttatgtcagagatgatgtcactggtgagttaacggtgggtgatatgagaaaacccagttcgccgttagtcaatgtgacggaatctgatgtggatacttggtgggatgctgacgccgttattgttgagaatgaatgtgagaaatctgtttga

SEQ ID NO: 292 - protein, 332 aa, Populus trichocarpa
MEIPVINRISDFETGLASLQNPTFLSQILALSGVEKIHQAYSFWKWGALILALAASFTAIINRIKILIIRFKNHPFISSPSLISNQEDCDYESETDLSCSSSISLSDDEQEEESTSSSRSWWSINDHDQDFRVRGSGNRYIDDQCQGGNFRLRRRRNSSIGDFFSLTDFTNGKNVVKLWDNLGLSLGLNLNNSCDSRNAAVSFYDINKEQKICSIFGSTCDSIFAAVSTSPSVVVSAETNLSGHSSLSLWDTRVGFRVPEVFAELRPTLGKIVGVVVGGVEKVYVRDDVTGELTVGDMRKPSSPLVNVTESDVDTWWDADAVIVENECEKSV

SEQ ID NO: 293 - DNA, 945 bp, Citrus clementina
atggagattctagtagtcaatagaataattgatttcgaaacaaacataaacccttcattagtatcccaagtttctgcagtttctgggattggcaagttttaccaaacttacaatttatggaagtggggcgctttaatacttgccctaattgcttcgttcacaactataatcaatagagtcaaggctttgattgttaaattacagaaacacccttctctgtcctcatcacaacatcatcagcttctcgatgacgacgattgcgagacagattctatttcttcggacgacgaagacgaacaagaacgagatggtgatggcgatgaagaagaagaggaggaagaggaggagtcaggaacgacgccgttttatacttctcggaactggcaacgacatgttgacgaagattttcgcgtgagaggttctggagacgtgtgcgacgacgacgaacaatggaaaaaccgtaatttgggacttagacgacgtcgtaggaatatcggagatctattctcttggtcggagttgatgatgactagtggcaaaaacgttgttaagctttgggataatctcgggttaggattaggcttaaacttggaagattattcggaaaacgagtttacgatttacgacatgaattatgaacgagaattccgaaaaatcgcctccattttcggcaggaaagacgagagtccggcgtttgtttctgcatcgtcgtccccggcggtgatcgtctccgccgccacgagtggcagcggcagagttgcgttaggtgggtgggacacgcgtatcggttcgagaattgcggcgatgctggccgaatggcggccgaaactcgggaatatcgttgggatcagggccggaagaattgagaaagttctcgtcagggaaagcgtcattaacgcgtttacggttgttgacctgcgcaaaggtaactcgccctttaaataa

SEQ ID NO: 294 - protein, 314 aa, Citrus clementina
MEILVVNRIIDFETNINPSLVSQVSAVSGIGKFYQTYNLWKWGALILALIASFTTIINRVKALIVKLQKHPSLSSSQHHQLLDDDDCETDSISSDDEDEQERDGDGDEEEEEEEEESGTTPFYTSRNWQRHVDEDFRVRGSGDVCDDDEQWKNRNLGLRRRRRNIGDLFSWSELMMTSGKNVVKLWDNLGLGLGLNLEDYSENEFTIYDMNYEREFRKIASIFGRKDESPAFVSASSSPAVIVSAATSGSGRVALGGWDTRIGSRIAAMLAEWRPKLGNIVGIRAGRIEKVLVRESVINAFTVVDLRKGNSPFK

SEQ ID NO: 295 - DNA, 867 bp, Citrus clementina
atggagattctagtagtcaatagaataattgatttcgaaacaaacataaacccttcattagtatcccaagtttctgcagtttctgggattggcaagttttaccaaacttacaatttatggaagtggggcgctttaatacttgccctaattgcttcgttcacaactataatcaatagagtcaaggctttgattgttaaattacagaaacacccttctctgtcctcatcacaacatcatcagcttctcgatgacgacgattgcgagacagattctatttcttcggacgacgaagacgaacaagaacgagatggtgatggcgatgaagaagaagaggaggaagaggaggagtcaggaacgacgccgttttatacttctcggaactggcaacgacatgttgacgaagattttcgcgtgagaggttctggagacgtgtgcgacgacgacgaacaatggaaaaaccgtaatttgggacttagacgacgtcgtaggaatatcggagatctattctcttggtcggagttgatgatgactagtggcaaaaacgttgttaagctttgggataatctcgggttaggattaggcttaaacttggaagattattcggaaaacgagtttacgatttacgacatgaattatgaacgagaattccgaaaaatcgcctccattttcggcaggaaagacgagagtccggcgtttgtttctgcatcgtcgtccccggcggtgatcgtctccgccgccacgagtggcagcggcagagttgcgttaggtgggtgggacacgcgtatcggttcgagattgccggcgatgctggccgaatggcggccgaaactcgggaatatcggttgggatcaagggcggaggaattga

SEQ ID NO: 296 - protein, 288 aa, Citrus clementina
MEILVVNRIIDFETNINPSLVSQVSAVSGIGKFYQTYNLWKWGALILALIASFTTIINRVKALIVKLQKHPSLSSSQHHQLLDDDDCETDSISSDDEDEQERDGDGDEEEEEEEEESGTTPFYTSRNWQRHVDEDFRVRGSGDVCDDDEQWKNRNLGLRRRRRNIGDLFSWSELMMTSGKNVVKLWDNLGLGLGLNLEDYSENEFTIYDMNYEREFRKIASIFGRKDESPAFVSASSSPAVIVSAATSGSGRVALGGWDTRIGSRLPAMLAEWRPKLGNIGWDQGRRN

SEQ ID NO: 297 - DNA, 942 bp, Citrus clementina
atggagattctagtagtcaatagaataattgatttcgaaacaaacataaacccttcattagtatcccaagtttctgcagtttctgggattggcaagttttaccaaacttacaatttatggaagtggggcgctttaatacttgccctaattgcttcgttcacaactataatcaatagagtcaaggctttgattgttaaattacagaaacacccttctctgtcctcatcacaacatcatcagcttctcgatgacgacgattacgagacagattctatttcttcggacgacgaagacgaacaagaacgagatggtgatggtgatggtgatggcgatgaagaagaagatgaggaagaggaggagtcaggaacgacgccgttttatacttctcggaactggcaacgacatgttgacgaagattttcgcgtgagaggttctggagacgtgtacgacgacgacgaacaatggcaaaaccgtaatttgggacttagacgacgtcgtaggaacatcggagatctattctcttggtcggagttgatgatgactagtggcaaaaacgttgttaagctttgggataatctcgggttaggattaggcttaaacttggaagattattcggaaaacgagtttacgatttacgacatgaattatgaacgagaattccgaaaaatcgcctccattttcggcaggaaagacgagagtccggcgtttgtttctgcatcgtcgtccccggcggtgatcgtctccgccgccacgagtggcagcggcagagttgcgttaggtgggtgggacacgcgtatcggttcgagattgccggcgatactggccgaatggcggccgaaactcggggaatatcgtgggatcaaaggccggagaattgagaaaagtctcctcagggatagcgtcagtaacgcgttaacgggtgggggacatgcccaaggttaa

SEQ ID NO: 298 - protein, 313 aa, Citrus clementina
MEILVVNRIIDFETNINPSLVSQVSAVSGIGKFYQTYNLWKWGALILALIASFTTIINRVKALIVKLQKHPSLSSSQHHQLLDDDDYETDSISSDDEDEQERDGDGDGDGDEEEDEEEEESGTTPFYTSRNWQRHVDEDFRVRGSGDVYDDDEQWQNRNLGLRRRRRNIGDLFSWSELMMTSGKNVVKLWDNLGLGLGLNLEDYSENEFTIYDMNYEREFRKIASIFGRKDESPAFVSASSSPAVIVSAATSGSGRVALGGWDTRIGSRLPAILAEWRPKLGEYRGIKGRRIEKSLLRDSVSNALTGGGHAQG

SEQ ID NO: 299 - DNA, 723 bp, Citrus clementina
atggagattctagtagtccatagaataattgatttccaaacaaacataaacccttcattagtatcccaagtttctgccgtttctgggattggcaagttttaccaaacttaccatttatggaagtggggcgctttaatacttgccctaattgcttcgttcacaactataatcaatagagtcaaggctttgattgttaaattacagaaacacccttctctgtcctcatcacaacatcatcagcttctcgatgacgacgattgcgagacagattctatttcttcggacgacgaagacgaacaagaacgagatggtgatggcgatgaagaagaagaggaggaagaggaggagtcaggaacgacgccgttttatacttctcggaactggcaacgacatgttgacgaagattttcgcgtgagaggttctggagacgtgtgcgacgacgacgaacaatggaaaaaccgtaatttgggacttagacgacgtcgtaggaatatcggagatctattctcttggtcggagttgatgatgactagtggcaaaaacgttgttaagctttgggataatctcgggttaggattaggcttaaacttggaagattattcggaaaacgagtttacgatttacgacatgaattatgaacgagaattccgaaaaatcgcctccattttcggcaggaaagacgagagtccggcgtttgtttctgcatcgtcgttccggcggtga

SEQ ID NO: 300 - protein, 240 aa, Citrus clementina
MEILVVHRIIDFQTNINPSLVSQVSAVSGIGKFYQTYHLWKWGALILALIASFTTIINRVKALIVKLQKHPSLSSSQHHQLLDDDDCETDSISSDDEDEQERDGDGDEEEEEEEEESGTTPFYTSRNWQRHVDEDFRVRGSGDVCDDDEQWKNRNLGLRRRRRNIGDLFSWSELMMTSGKNVVKLWDNLGLGLGLNLEDYSENEFTIYDMNYEREFRKIASIFGRKDESPAFVSASSFRR

SEQ ID NO: 301 - DNA, 801 bp, Gossypium hirsutum
atggaaattccggttatcaacaggataagcgatttcgaagctagcataagcactctaaacaacccatcttttctttcccaagtttatgccctttctgggattgataaaatctaccaagcttatcatttttggaaatggggggctttgattcttgccctgctggcctccttatctaccataatcaatagactcaagattctggttatcagattccgacgaaaccattctctaccatctcgacctcttctttatgacacagattttgatactgactcggagacttcatcatgttcatcatcggacaacgaagtagaatatgaggagccctcggcttctcaaagctggcgacaagttgatgaggattttcgagtgagaggatcgggtcattttattgacgatcaatggcggaacagtggctccaccctgcgaaagaggagaagcagcatcggcgatctgttttcgtgggctgaagagctaaccagcggaaaaagcgtggtgaagctgtgggacaacttaggattagggttccgtttggacctcgatgaaagcgacaacgttttaaatgtttacgacatcaacaaagaaacaaaaatcaagtcaatatttggggagaagagcgactttcaggcggtttcagcatcgtcgtcgtcgccagcagttgtagtctccaccggcggtgattcgtcaactcgacgagtcgccgtcagtgcatgggacacgcgccttgattgccggcagccggtgattctaacagaatggagccccgaaaaaccatggagaaatctcagcggtcaatactga

SEQ ID NO: 302 - protein, 266 aa, Gossypium hirsutum
MEIPVINRISDFEASISTLNNPSFLSQVYALSGIDKIYQAYHFWKWGALILALLASLSTIINRLKILVIRFRRNHSLPSRPLLYDTDFDTDSETSSCSSSDNEVEYEEPSASQSWRQVDEDFRVRGSGHFIDDQWRNSGSTLRKRRSSIGDLFSWAEELTSGKSVVKLWDNLGLGFRLDLDESDNVLNVYDINKETKIKSIFGEKSDFQAVSASSSSPAVVVSTGGDSSTRRVAVSAWDTRLDCRQPVILTEWSPEKPWRNLSGQY

SEQ ID NO: 303 - DNA, 936 bp, Populus trichocarpa
atggagatcccagtgatcaacagaataagcgatttcgagactggcatatcttctctgcaaaacccatcatttctttcccagattttagctctatccggagccgaaaaaattcaccaagcttacagtttttggaaatggggcgctctccttcttgccctagtcgcctctttcacaaccataattaacagaatcaagattctggtcatccgattcaaaaaccaccccttcatctcctcaccatctcttattaccaatcaagaagacggcgattacgaaagcgaaaccgacttatcctgctcgtcgtcaatatccttatcagatgaggagcaggaagaagagcccccatcaacttcacgaagctggtggtccattaatgatcatgatgaagatttctgtgtcagaggttctggcaatcgttacattgatgatcaatggcaaaacggtaattttaggctccggagacgacgaaacagcagcattggagactttttttcgttgtctgatttcacaaatgagagaaacgtggtaaagctctgggataatttaggattaggcctaggtttcaaccttaacaacggcggcgattcaaggagtgcggtcgtttctttctatgacattaataatgagcgaaacatatgttccatttttggcagcaaatgtgatagtttcactgctgtttccccccgtgttgggtttcggatgccggaggtttttgcggagctgagacctatgctggggaagattgtcggtgtcagtggcggcggtggcggtggcgcgaagaaggtttatgtcagagatgatgtcactggtgagttaacggtgggtgatataagaaaagtcagttcgccgttagtcaatgtgacggagtctgatgtggatacctggtgggatgctgacgccgttattgttgaggatgaatgtgaaaagtctgtatga

SEQ ID NO: 304 - protein, 311 aa, Populus trichocarpa
MEIPVINRISDFETGISSLQNPSFLSQILALSGAEKIHQAYSFWKWGALLLALVASFTTIINRIKILVIRFKNHPFISSPSLITNQEDGDYESETDLSCSSSISLSDEEQEEEPPSTSRSWWSINDHDEDFCVRGSGNRYIDDQWQNGNFRLRRRRNSSIGDFFSLSDFTNERNVVKLWDNLGLGLGFNLNNGGDSRSAVVSFYDINNERNICSIFGSKCDSFTAVSPRVGFRMPEVFAELRPMLGKIVGVSGGGGGGAKKVYVRDDVTGELTVGDIRKVSSPLVNVTESDVDTWWDADAVIVEDECEKSV

SEQ ID NO: 305 - DNA, 840 bp, Populus trichocarpa
atggagatcccagtgatcaatagaataagcgatttcgagacaggcttagcctctctgcaaaacccaacatttctttcccagattcttgcactttctggtgtcgaaaaaattcaccaagcttatagtttttggaaatggggcgctctgattcttgccctggccgcctctttcacagccataattaatagaatcaagattctcatcatccgattcaaaaaccaccccttcatctcttcaccatctcttattagcaatcaagaagattgtgattacgaaagcgaaacagacttatcttgctcatcatcaatatccttatcagatgacgaacaggaagaagagtccacatcatcttcaagaagttggtggtccattaatgatcatgatcaagacttccgggttagaggctctgggaatcgttacattgacgatcaatgccagggtggtaattttaggctccggagacgacgaaacagcagcattggagactttttttcgttgactgatttcacaaacgggaaaaacgttgtaaagctttgggataatttaggattaaagacaaatttgtcgggtcattcatcgttgagtttatgggacacccgagttgggtttcgggtgccggaggtttttgcggaattaaggcctacgttggggaagattgtgggtgtcgtcgtcggcggcgtagagaaggtttatgtcagagatgatgtcactggtgagttaacggtgggtgatatgagaaaacccagttcgccgttagtcaatgtgacggaatctgatgtggatacttggtgggaaactgacgccgttattgttgagaatgaatgtgagaaatctgtttga

SEQ ID NO: 306 - protein, 279 aa, Populus trichocarpa
MEIPVINRISDFETGLASLQNPTFLSQILALSGVEKIHQAYSFWKWGALILALAASFTAIINRIKILIIRFKNHPFISSPSLISNQEDCDYESETDLSCSSSISLSDDEQEEESTSSSRSWWSINDHDQDFRVRGSGNRYIDDQCQGGNFRLRRRRNSSIGDFFSLTDFTNGKNVVKLWDNLGLKTNLSGHSSLSLWDTRVGFRVPEVFAELRPTLGKIVGVVVGGVEKVYVRDDVTGELTVGDMRKPSSPLVNVTESDVDTWWETDAVIVENECEKSV

SEQ ID NO: 307 - DNA, 1026 bp, P. trifoliata
atggagattctagtagtcaatagaataattgatttcgaaacaaacataaacccttcattagtatcccaagtttctgcagtttctgggattggcaagttttaccaaacttacaatttatggaagtggggcgctttaatacttgccctaattgcttcgttcacaactataatcaatagagtcaaggctttgattgttaaattacagaaacacccttctctgtcctcatcacaacatcatcagcttctcgacgacgacgattacgagacagattcaatttcttcggacgacgaagacgaacaagaacgaggaggcgatggcgatgaagaagaagacgaggaagaggaggagtcaggaacgacgccgttttatacttctcggaactggcaacgacatgttgacgaagattttcgcgtgagaggttccggagacgtgtacgacgacgacgaacaatggcaaaaccgtaatttgggacttagacgacgtcgtaggaacatcggagatctattctcttggtcggagttgatgatgactagtggcaaaaacgttgttaagctttgggataatctcgggttaggattaggcttaaacttggaagattattcggaaaacgagtttacgatgtatgacatgaattatgaacgagaattccgaaaaatcgcctccattttcggcaggaaagacgagagtccggcgtttgtttctgcatcgtcgtccccggcggtgatcgtctccgccgccaggagaggcagcggcagagttgcgttaggtgggtgggacacgcgtatcggttcgagattgccggcgatgctggccgaatggcggccgaaactcgggaatatcgttgggataaaggccggaggaattgagaaagttctcgtcagggatagcgtcagtaacgcgttaacggttggtgacatgcgcaaggttaactcgccgttagatgacccgaccgaggctgacgtggacacgtggtgggatgctgacgctgttattgtgacggaggactgcttggacaactcaaattag

SEQ ID NO: 308 - protein, 341 aa, p. trifoliata
MEILVVNRIIDFETNINPSLVSQVSAVSGIGKFYQTYNLWKWGALILALIASFTTIINRVKALIVKLQKHPSLSSSQHHQLLDDDDYETDSISSDDEDEQERGGDGDEEEDEEEEESGTTPFYTSRNWQRHVDEDFRVRGSGDVYDDDEQWQNRNLGLRRRRRNIGDLFSWSELMMTSGKNVVKLWDNLGLGLGLNLEDYSENEFTMYDMNYEREFRKIASIFGRKDESPAFVSASSSPAVIVSAARRGSGRVALGGWDTRIGSRLPAMLAEWRPKLGNIVGIKAGGIEKVLVRDSVSNALTVGDMRKVNSPLDDPTEADVDTWWDADAVIVTEDCLDNSN

SEQ ID NO: 309 - DNA, 1014 bp, Ricinus communis
ctcacggcccttaaccgcgtagcaataccgagtcaggactactgcccaccccattatcttcttctccaacgcttacgccgtcagcgtcccaccacgtgtccacgtcagtttccgtcgcattcactaacggcgacttcacttttctcatatcacccaccgtcaacctccccgtgacgtcatctcttacgtataccttccccactccgccgccgccgctgctaattccaacaaattttcccaatctcggtcgccactccgccagtatctccggtatccgacatccaacacgcgtgtcccacacttttaacaagttcccggccacatttgcctcggaggaaacaatcaccgccggcgatgaagaggacgtggaaaccgccggaatatcggatctctcgcctaaaatagaaaagaggcttagttctttattgatgtcatgaagagaaacgcagtttcttgaattgttatcaagattcaaaccaaatccaaaccctaaattatcccatagcttcactacgctcttgccattcctgaactcagaaaataaatcttgaaggctgctatttctacgtctccttaaattacgattctgccactggtcatcgatataatgacctgatcctttaacgacactgtaataatcatcgtcgtcgttggacctccaagaacatcgctcgtcctcatcttcttcatcatcttccacttctatgtcctgttcgtcgtctgaagaagaagaagaagaggtttctgattcggtatcggagtcgtaatgctgttgggtggtaagaggaggaggcggtgaaggtgtcaaataatggttttggattcgaatgatgagattcttgattctgttgattatagtagagaaagaggcgacaagggcgagaattagagctccccatttccagaaaccgtaagcttggtgaattttttccacaccagataatgtaattgcttgtgaaagaaaagatgggttttgcaaagaggcttcgaaatcacctattctgttgatcactg

SEQ ID NO: 310 - protein, 337 aa, Ricinus communis
MEIPVINRIGDFEASLQNPSFLSQAITLSGVEKIHQAYGFWKWGALILALVASFSTIINRIKNLIIRIQNHYLTPSPPPPLTTQQHYDSDTESETSSSSSSDDEQDIEVEDDEEDEDERCSWRSNDDDDYYSVVKGSGHYIDDQWQNRNLRRRRNSSLQDLFSEFRNGKSVVKLWDNLGFGFGLNLDNNSRNCVSLHDINKELSLFSILGERSDIPAVSTSSSSPAVIVSSEANVAGNLLKVWDTRVGCRIPEILAEWRPRLGKFVGISSGGGGVGKVYVRDDVTGRLTVGDMRKVKSPLVNATETDVDTWWDADGVSVGEEDNGVGSSPDSVLLRG

SEQ ID NO: 311 - DNA, 924 bp, Arabidopsis lyrata
atggaggtaccggtgattaatagaataagagatttcgaagttggaataaactcgattaatgatccttcgtttctttctcgatctgttgctgtttccggaatcggaaagttacaccaagcttatggtttttggaaatggggagctttgattattgcatttctagcttatttcacaaactttgttagtaaactcaacagtttagttgttaggttaataaaaatagatgtctctgtttcttctccaactctttttgatgattacgatagcgattccgatgtttcttgttcgtctaccgtctcatctgacgatgaagaagacgaagaggatgaggatgatgatgaagatgaggatgttgactcgatctttaatcgaagacgagtcaacggaggtttccgcgtgagaggatctgattattatgatgatgatgatgatcagggagaaaatggtaattgcacatggatggggaggcgatgtagtggtagcattggagatttgttctcatggcctgatcttggtgggattggttcgagtggagtcgtgaagctttgggatcatttagatattgatggcgatgatgatgatcatgagaatgttgtggccacgtttctcaagaattgtagctcaacctcgtcgctttttttggcggcggagaagaaaggtgttgacgccgttaaagtgaaggcgtgtgatccacgcgccggttttaagatgccggctttgctcgcggagtggaggcagccggggcggttgttagggaatattatcggtgttgatgctggtggtgtggagaaagtttacgtcagggatgatgttagtggagaaatagccgtgggagatttgaggaagtttaacggtgtgttgacggacttgacggaatctgaggctgagacttggtgggacgctgacgtcgttatctcgggctga

SEQ ID NO: 312 - protein, 307 aa, Arabidopsis lyrata
MEVPVINRIRDFEVGINSINDPSFLSRSVAVSGIGKLHQAYGFWKWGALIIAFLAYFTNFVSKLNSLVVRLIKIDVSVSSPTLFDDYDSDSDVSCSSTVSSDDEEDEEDEDDDEDEDVDSIFNRRRVNGGFRVRGSDYYDDDDDQGENGNCTWMGRRCSGSIGDLFSWPDLGGIGSSGVVKLWDHLDIDGDDDDHENVVATFLKNCSSTSSLFLAAEKKGVDAVKVKACDPRAGFKMPALLAEWRQPGRLLGNIIGVDAGGVEKVYVRDDVSGEIAVGDLRKFNGVLTDLTESEAETWWDADVVISG

SEQ ID NO: 313 - DNA, 876 bp, Arabidopsis lyrata
atggaggtcccgataataaacagaataagcgattttgacgtggggataaactcgataaacgacccgtcgtatttatctcgagctttggccgtctccggcgtcggaaagttacatcaagcttatagtttctggaaatggggcgctttattgctacttgcattttttgcttcatttacatcgttaactacaagaatcaaggctttagtctttagattaagaaacgtaaacgtgtctctaccttccccaactcttttgtgtaattacgacagcgattccgattggtcttttgcgtcagactcttcagacgaagatgatgacgatgacaaagaagatgaatcggtcaatggagatttacgcgttaaaagatttagttatttccatgatgatgatgataaggctataaatggtaatgtcccctggttgcggcggtgcagtggtagcttcggagacttgttagatttaggctcgagcggagtcgtgaagctttgggacaatcttgatttcaacggagaaggaagtcaccataacgcggtggcttcttttttgagcaaatgcggctcttactcgttgttgtcgtcgacggttttattagcggcggagaagaaaggatccgacggcctggaagtgagtgcgtgggatgcacgcgtcggttttggggtccccgcgttgctcgcggaatggaagcagccggggcggttgcttgggaagatcattagggttgacgtcggtgacgtggacaagatctacgtcggtgatgacgtcggaggagagattactgtgggagacatgaggatggttaacggtgcgttgacagaactgacggaatcagaggttgagggaatggtgagaagacgccgacgccgacgccgtcattga

SEQ ID NO: 314 - protein, 291 aa, Arabidopsis lyrata
MEVPIINRISDFDVGINSINDPSYLSRALAVSGVGKLHQAYSFWKWGALLLLAFFASFTSLTTRIKALVFRLRNVNVSLPSPTLLCNYDSDSDWSFASDSSDEDDDDDKEDESVNGDLRVKRFSYFHDDDDKAINGNVPWLRRCSGSFGDLLDLGSSGVVKLWDNLDFNGEGSHHNAVASFLSKCGSYSLLSSTVLLAAEKKGSDGLEVSAWDARVGFGVPALLAEWKQPGRLLGKIIRVDVGDVDKIYVGDDVGGEITVGDMRMVNGALTELTESEVEGMVRRRRRRRRH

SEQ ID NO: 315 - DNA, 867 bp, Arabidopsis thaliana
atggaggtcccgattataaacagaataggcgattttgacatggggataaactcgataaacgacccgtcgtatttatctcgagctttggcagtctccggtgtcggaaagttacatcaagcttatagtttttggaaatggggcgccttattgctacttgcattttttgcttcatttacatcgttaactacaagaatcaagactttagtctttagattaagaaatgtaaacgtgtctctaccttcccaaactcttttatgtaattacgacagcgactccgattggtctttctcgtcagactcttcagacgaagagaaagatgaggacgataacaaagaagatgactcggtcaatggcgattcacgcgttcaaagatttggttattaccatgatgatgatgataagggtattagtggaagtgtcccctggttgcggcggtgcagtggtagcttcggagatttgttagatttaggctcaagcggagtcgtgaagctttgggacaatcttgatttcaacggagaaggaagtccggtggcttcttttttcagcaaatgcggctcatactcgttattgtcatcggcggttttattagcggcggagaagaaaggatccgacggcttggaagtgagtgcgtgggatgcacgcgttggttttggggtgcccgcgttgctcgcggaatggaagcagccgggaaggttactcgggaagatcattagggttgacgtaggtgacgtggacaagatctacgtcggtgatgacgtcgaaggagagattactgtgggagacatgaggatggttaacggtgcgttgacggaactgacggaatcagaggttgagaggatggtgagaagacgcagacgccgtcattga

SEQ ID NO: 316 - protein, 288 aa, Arabidopsis thaliana
MEVPIINRIGDFDMGINSINDPSYLSRALAVSGVGKLHQAYSFWKWGALLLLAFFASFTSLTTRIKTLVFRLRNVNVSLPSQTLLCNYDSDSDWSFSSDSSDEEKDEDDNKEDDSVNGDSRVQRFGYYHDDDDKGISGSVPWLRRCSGSFGDLLDLGSSGVVKLWDNLDFNGEGSPVASFFSKCGSYSLLSSAVLLAAEKKGSDGLEVSAWDARVGFGVPALLAEWKQPGRLLGKIIRVDVGDVDKIYVGDDVEGEITVGDMRMVNGALTELTESEVERMVRRRRRRH

SEQ ID NO: 317 - DNA, 921 bp, Arabidopsis thaliana
atggaggtaccggtgattaatagaataagagatttcgaagttggtataaactcgattaatgatccttcgtttctttctcgatctgttgctgtttccggaatcggaaagctacaccaagcttatggtttttggaaatggggagctttgattatcgcatttctagcttatttcaccaactttgttagtaaactcaacagtctagttgttaggttaagaaaaatagatgtctctgtttcctctccaactctttttgatgattacgatagcgattccgatgtttcttgttcctctaccgtctcctctgacgatgaaaaagacgaagaagatgaggctgatgatgaagatgaggatgttgactcgatctttaatcgaagacgagtcaacggaggtttccgcgttagaggatctgattattacgatgatgatgatgatcagggagacaatggtaattgcacatggatggggaggcgatatagtggtagttttggagatttgttctcatggcctgatcttggtgggattggttcgagtggagtcgtgaagctttgggatcatttagatatcgatggcgatgatcatgagaatgttgtggcaacgtttctcaagaactataactcaacctcgtcaccgtttttttgggcggcggagaaaaaaggtgttgacgccgttaaagtgaaggcgtgtgatccacgcgccggttttcggatgccggctttgctcgcggagtggaggcagccggggcggttgttagggaatataatcggagttgataccggtggtgtggagaaagtatacgtcagggatgatgttagcggagagatagccgtgggagatttgaggaagtttaacggtgtgttgacggacttgacggaatgtgaggctgagacttggtgggacgctgacgtccttatctcgggctga

SEQ ID NO: 318 - protein, 306 aa, Arabidopsis thaliana
MEVPVINRIRDFEVGINSINDPSFLSRSVAVSGIGKLHQAYGFWKWGALIIAFLAYFTNFVSKLNSLVVRLRKIDVSVSSPTLFDDYDSDSDVSCSSTVSSDDEKDEEDEADDEDEDVDSIFNRRRVNGGFRVRGSDYYDDDDDQGDNGNCTWMGRRYSGSFGDLFSWPDLGGIGSSGVVKLWDHLDIDGDDHENVVATFLKNYNSTSSPFFWAAEKKGVDAVKVKACDPRAGFRMPALLAEWRQPGRLLGNIIGVDTGGVEKVYVRDDVSGEIAVGDLRKFNGVLTDLTECEAETWWDADVLISG

SEQ ID NO: 319 - DNA, 1008 bp, Aquillegia
tcttactttgttaaggttagaaaatacagcattccggcaccgagatacaactgacccacattccttccgacctaaataacaaatttcgcgatcaccttcaacaataacagcatcagtatcccaccatgtattcacgtcagattccgttaaatttaacggtgatcctagtttccttatatctctaatcaccagggaatttgcattactatcaatgtcgtcgctgcagttagtacgctgccattctgcgaatatttgtggaatctggcgacccacacggttgtcaaaaactcttaacgccatgcttctactagtttctaaaccagcagatacaatgacagccggagacggcattgataacgccggaatatgacataatccgccggaaaatgagtttgtgatttcattcttgtttaattcccataatgtaatgagactttctgatgctttttcaagcccaaatcctaagcccaatccatcccatgacttaactacactttttccgttaaccaaatctgaccaagagaatataaactctccgttactgctattccgtctagaaagcttcaatttaccctttcgccctcgtatttcttcaaatttaccagaacctgcaactctaaaatcttcatcaaatcttcttctttcattattatcatacgtggcatcatcttcatcgtccgatacagaagaacaagtctcctcttcgtaatcttcttcttctacctcgctatcatcgtcgtcatcatcttcgcaaagttgttgcagtagaggttgtgaaatgactgatttacccttttgaaatctgaaaatgattaaattgatatttctggtaataacgcagctaaaagttgcaaatatagctataatcaaagcacctaaagtccaaaaagtgtgaactttaatggtgttttcaattgatgtaagatgaagaacacgagatatgaaagatgggttagcttcaaaactgcttattctactaataactggtatttccattgaaacaagaag

SEQ ID NO: 320 - protein, 335 aa, Aquilegia
MEIPVISRISSFEANPSFISRVLHLTSIENTIKVHTFWTLGALIIAIFATFSCVITRNINLIIFRFQKGKSVISQPLLQQLCEDDDDDDSEVEEEDYEEETCSSVSDDEDDATYDNNERRRFDEDFRVAGSGKFEEIRGRKGKLKLSRRNSSNGEFIFSWSDLVNGKSVVKSWDGLGLGFGLEKASESLITLWELNKNEITNSFSGGLCHIPALSMPSPAVIVSAGLETSRSMALRVFDNRVGRQIPQIFAEWQRTNCSDDIDSNANSLVIRDIRKLGSPLNLTESDVNTWWDTDAVIVEGDREICYLGRKECGSVVSRCRNAVFSNLNKVRNYI

SEQ ID NO: 321 - DNA, 1023 bp, Aquilegia
ttgccgtcattcaattttatatgtaatttcttactttgttaaggttagaaaatacagcattccggcaccgagatacaactgacccacattccttccgacctaaataacaaatatcgcgatcaccttcaacaataacagcatcagtatcccaccatgtattcacgtcagattccgttaaatttaacggtgatcctagtttccttatatctctaatcaccagggaatttgcattactatcaatgtcgtcgctgcagttagtacgctgccattctgcgaatatttgtggaatctggcgacccacacggttgtcaaaaactcttaacgccatgcttctactagtttctaaaccagcagatacaatgacagccggagacggcattgataacgccggaatatgacataatccgccggaaaatgagtttgtgatttcattcttgtttaattcccataatgtaatgagactttctgatgctttttcaagcccaaatcctaagcccaatccatcccatgacttaactacactttttccgttaaccaaatctgaccaagagaatataaactctccgttactgctattccgtctagaaagcttcaatttaccctttcgccctcgtatttcttcaaatttaccagaacctgcaactctaaaatcttcatcaaatcttcttctttcattattattatcatacgtggcatcatcttcatcgtccgatgataatgatgatacagaagaacaagtctcctcttcgtaatcttcttcttctacctcgctatcatcgtcgtcatcatcttcgcaaagttgttgcagtagaggttgtgaaatgactgatttacccttttgaaatctgaaaatgattaaattgatatttctggtaataacgctgctaaaagttgcaaatatagctataatcaaagcacctaaagtccaaaaagcgtgaactttaatggtgttttcaattgatgtaagatgaagaacacgagatatgaaagatgggttagcttcaaaactgcttattctacaaa

SEQ ID NO: 322 - protein, 340 aa, Aquilegia
MEIPVICRISSFEANPSFISRVLHLTSIENTIKVHAFWTLGALIIAIFATFSSVITRNINLIIFRFQKGKSVISQPLLQQLCEDDDDDDSEVEEEDYEEETCSSVSSLSSDDEDDATYDNNNERRRFDEDFRVAGSGKFEEIRGRKGKLKLSRRNSSNGEFIFSWSDLVNGKSVVKSWDGLGLGFGLEKASESLITLWELNKNEITNSFSGGLCHIPALSMPSPAVIVSAGLETSRSMALRVFDNRVGRQIPQIFAEWQRTNCSDDIDSNANSLVIRDIRKLGSPLNLTESDVNTWWDTDAVIVEGDRDICYLGRKECGSVVSRCRNAVFSNLNKVRNYI

SEQ ID NO: 323 - DNA, 705 bp, Glycine max
atgttgctgctgctgcttacacttccttccttctgcaaatggggtcttttctttctcaccctactcctcaccgctttcatcttccgcctccgccaaaacgcacctccctttcctcttatcatcgctacttatgattatagtgacaccgacgacgacgacggcatctcctccacgtcggagtttgaagacgacgatgatgaagaagaagaaaatgaagaagacagaagggatgagtattttagagtcagaggttctaccaacgacgaacgacgtcgtagcattgctgatttcttgtctctttcagaaatcgccaacaccaaaagcgtcgttaagttatgggacaccatagggtttgggctagggtttggttttgagcacgttgatgaccgttcatctgatggaagcagaatcgtctccgtttacgacggggagcttcctgatccggcggtggtggtttccgccggcgaaaacgcgtcggggaatttagcggtgacgatttgggacacgcgactccggcggcggataccggcgatgatggcggagtggggaccgagccttgggaagaccgttggagttgttgaatccagccaagtacacaagctttacgtcaaagatgacggccgttacgggtttacggtgggtgacatgagaaatgccaggtcgccgttacaatatgtaacggattcacacctcgatttgtggtag

SEQ ID NO: 324 - protein, 234 aa, Glycine max
MLLLLLTLPSFCKWGLFFLTLLLTAFIFRLRQNAPPFPLIIATYDYSDTDDDDGISSTSEFEDDDDEEEENEEDRRDEYFRVRGSTNDERRRSIADFLSLSEIANTKSVVKLWDTIGFGLGFGFEHVDDRSSDGSRIVSVYDGELPDPAVVVSAGENASGNLAVTIWDTRLRRRIPAMMAEWGPSLGKTVGVVESSQVHKLYVKDDGRYGFTVGDMRNARSPLQYVTDSHLDLW

SEQ ID NO: 325 - DNA, 936 bp, Glycine max
atgcaagttccattgatcgacaggatcaacgatctccaagtgggtctgaactctctgcagaacccatctttcccttctcagatcacaacctccctcgcttacaatttctgcaaatggggcgcagtcattctcgcccttgtcgccaccttcggcagcataatcaacagagtcaccatcttcatcatccacttccgcgccaaagccccttctctcccatccctaaaccttaacgacgacgatttttacacctcctctgacgacgaagacgacttccaaaacgacgaggacgacgacctaacctactcctcttccgagcccgaagacgagccctccgcgtcttccagcttcatccgtttggaagactatttccgaatcagaggaaccgataacctagacgacgagtttcagactcaaaacggcacgcacaaacgatgtcgtagcatcggggatattttttcgctctcggaactcgccaacagcaagagcgtggtcaagctctgggacagcataggcttcgggctggggttggatttcgatgattacgatggttacgaagtgagtagcgcgaagccgttgcaggcgccgacgagctccacggcatctcccgcggtggttgtctcggcgggggaaggcgcgtacgggaatctggcgctggagatttgggacacgcgcctgcggcggcggaagccgacggtggtggcggagtgggggcccaccgtgggaaagaccctgcacgtggaatctggcggcgtacagaaggtttacgtcagagatgacgggcgttacagcgtgacggtcggggacatgagaaaggtcagcacgccgttagggaacgtaacggaatctgacgcggatacttggtgggatgcggacgctattgttgtttcggacgagtcttttggcgaacagcaatcaatgttgcaacaaccaacttga

SEQ ID NO: 326 - protein, 311 aa, Glycine max
MQVPLIDRINDLQVGLNSLQNPSFPSQITTSLAYNFCKWGAVILALVATFGSIINRVTIFIIHFRAKAPSLPSLNLNDDDFYTSSDDEDDFQNDEDDDLTYSSSEPEDEPSASSSFIRLEDYFRIRGTDNLDDEFQTQNGTHKRCRSIGDIFSLSELANSKSVVKLWDSIGFGLGLDFDDYDGYEVSSAKPLQAPTSSTASPAVVVSAGEGAYGNLALEIWDTRLRRRKPTVVAEWGPTVGKTLHVESGGVQKVYVRDDGRYSVTVGDMRKVSTPLGNVTESDADTWWDADAIVVSDESFGEQQSMLQQPT

SEQ ID NO: 327 - DNA, 954 bp, Glycine max
atgcaagttccattgatcgacatcgacagaatcaacgatctccaagtgggtctgaactctctgcagaacccatccttcccaatcccttctcagatcacaacctccctcgcttacaatttctgcaaatggggcgcagtcattctcgcccttgtcgccaccttcggcagcatcatcaacagagtcactatcttcatcatccgcttccgcgccaaagccccttctctcccatccctaaccctaaacgacgacaatttttacacctcctcctcctctgacgacgacgacgacgacgataacgacgacgacctaacctactcctcttccgagcccgaagacgagccctccgcgtcttccagtttcatccgtttggacgactatttccgactcagaggaaccgataataataataataataacctagacgacgagtttcagactcaaaacggcacgcacaaacgatgtcgtagcatcggggatattttctccctctcggaactagccaacagcaagagcgtggtgaagctctgggacaccataggcttcggcctgggcttggacttcgatgattacgatggttactacgttggtaacgcggcggttccgacgagctccaccgcgtctccctcggtggttgtctcggcgggggaaggcgcgtgcgggaatctggcgctggagatctgggacacgcggctgcggcggcggaagcccacggtggtggcggagtggggtcccaccgtgggaaagaccctgcgcgtggaatctggtggcgtccagaaggtctacgtcagagatgacgggcgttacggcgtgacggtcggggatatgagaaaggtcagcacgccgttagagagcgtaacggaatctgacgcggatacttggtgggatgcggacgctattgttgtttcggacgagtcttttggcgaacagcaatcaatgttgcaacaaccaacttga

SEQ ID NO: 328 - protein, 317 aa, Glycine max
MQVPLIDIDRINDLQVGLNSLQNPSFPIPSQITTSLAYNFCKWGAVILALVATFGSIINRVTIFIIRFRAKAPSLPSLTLNDDNFYTSSSSDDDDDDDNDDDLTYSSSEPEDEPSASSSFIRLDDYFRLRGTDNNNNNNLDDEFQTQNGTHKRCRSIGDIFSLSELANSKSVVKLWDTIGFGLGLDFDDYDGYYVGNAAVPTSSTASPSVVVSAGEGACGNLALEIWDTRLRRRKPTVVAEWGPTVGKTLRVESGGVQKVYVRDDGRYGVTVGDMRKVSTPLESVTESDADTWWDADAIVVSDESFGEQQSMLQQPT

SEQ ID NO: 329 - DNA, 753 bp, H.paradoxus
atggaaattgcagagctcaatctcatcggcgacttcgaagccggaatcaaatgcttacaaaacccctccctcctctccaatctttctttacacaagtacagtttctggacatgtggcgccttaatcatcgccgttttcgccactttcactaacctgtttaacaaaatcaacctctttatacaccagatccgtttcagattcttatcctcctttcaaacctcatccccccagcaaattcaattcgacgatgatgattttgattttgacttttccgatgacgatatagacgatgatacgccgtcgtctgtagcagagtccgatgatgaagattatgattctgaggacacctgtgtgaatgaagttttccgtgttgaaggtagtggtagttgttattttgacgataacgaagggcaagaagggaatttcactctccggcggcgtaaccggttctcgtggtcggatttttcagccggaaaaagtgttgtacagttatgggatagttttggtttagggttagattttgaagacgatgatgatgaatcgggaattgcgatatgggatttgaatcgggatgtgaagttgagctccgggagacggtgtcaggttccggcgtcagtggcggagaaggttgtgttgacggcggagatggatgggagtcacggtggtgtcgggtttggtacgtatgattctcggatgggtgttacgtgtccggctgtttgtgccacgtggcagccacaacggaaggtggagtga

SEQ ID NO: 330 - protein, 250 aa, H.paradoxus
MEIAELNLIGDFEAGIKCLQNPSLLSNLSLHKYSFWTCGALIIAVFATFTNLFNKINLFIHQIRFRFLSSFQTSSPQQIQFDDDDFDFDFSDDDIDDDTPSSVAESDDEDYDSEDTCVNEVFRVEGSGSCYFDDNEGQEGNFTLRRRNRFSWSDFSAGKSVVQLWDSFGLGLDFEDDDDESGIAIWDLNRDVKLSSGRRCQVPASVAEKVVLTAEMDGSHGGVGFGTYDSRMGVTCPAVCATWQPQRKVE

SEQ ID NO: 331 - DNA, 753 bp, Helianthus petiolaris
atggaaattgcagagctcaatctcatcggcgacttcgaagccggaatcaaatgcttacaaaacccctctctcctctccaatctttctttacacaagtacagtttctggacatgtggcgccttaatcatcgccgttttcgccactttcactaacctatttaacaaaatcaacctcttcatacaccagatccgtttcagattcttatcctcctttcaaacctcatccccccaacaaattcaattcgacgatgatgatttcgattttgacttttccgatgacgatatagacgatgatacgccgtcgtctgtagcagagtccgatgatgaagattatgattctgaggacacccgtgtgaatgaagttttccgtgttgaaggtagtggtagtagttattttgacgataacgaagggcaagaaggtaatttcactctccggcggcgtaaccggttctcgtggtcggatttttccgccggaaaaagtgttgtacagttatgggatagttttggtttagggttagattttgaagacgatgatgatgaatcgggaattgcgatatgggatttgaatcgggatgtgaagttgagctccgggagacggtgtcaggttccggcgtcagtggcggagaaggttgttctgacggcggagatggatgggagtcacggtggtgtcgggtttggtacgtatgattctcggatgggtgttacgtgtccggctgtttgtgccacgtggcagccacgacggaaggtggagtga

SEQ ID NO: 332 - protein, 250 aa, Helianthus petiolaris
MEIAELNLIGDFEAGIKCLQNPSLLSNLSLHKYSFWTCGALIIAVFATFTNLFNKINLFIHQIRFRFLSSFQTSSPQQIQFDDDDFDFDFSDDDIDDDTPSSVAESDDEDYDSEDTRVNEVFRVEGSGSSYFDDNEGQEGNFTLRRRNRFSWSDFSAGKSVVQLWDSFGLGLDFEDDDDESGIAIWDLNRDVKLSSGRRCQVPASVAEKVVLTAEMDGSHGGVGFGTYDSRMGVTCPAVCATWQPRRKVE

SEQ ID NO: 333 - DNA, 936 bp, Lotus japonicus
atgcaagttcctttaatcgacaggctcaacgatcttcaagttggcttcaactctctgcaaaacccatcgttcccttctccaatcacctcctccctcgccggaatccaatccgtctcggtggtttacaatttctgcaagtggggcgctgtctttctcgctctcgtcgccacgttcagcagcatcatcaacagagtcaccgttttcatcatcagattccgcagcaaaccaccttctcttccttcaatctccctcttcgacgacgacttcagcgatatctcctccgacgacggcgatgttgatgacttagaagacgacgacgacaccggaaacgactcgtcgtcggagttcgacgacgagccctctgcctctgcttcttccagcttcctccgattggatgacttcttcttccgagtcaggggaaccgctcagaacgacgagtcatcacggagccaaatcgacacgcgccaccggagttgcagcattggggatatcttctccctggcggaactcgccagcagcgacagcgtcgtgaagctatgggacaccattggattcggtttggggctagatttcgatgattacgaggaaagtccactccacgcgccggcgagttcttccacggcgtccccggcggtggttgtttcagctgcggaaggctcacgcgggaacttggaggtggggatttgggacacgcgcctccggaagcggagaccgtcggtggtggcggagtgggggcccgccgtggggaagaccgtgcgcgtggaatctggcggcgtgtcgaaggtttatgtgagagataacggacgtgacggcgttacggttggtgacatgagaaaggtcagcaagccgttaggaaacgtgacggaatctgatgcggataatacctggtgggatgcttcggaggaacagcaatcatcaatgatgcaccaaacttga

SEQ ID NO: 334 - protein, 311 aa, Lotus japonicus
MQVPLIDRLNDLQVGFNSLQNPSFPSPITSSLAGIQSVSVVYNFCKWGAVFLALVATFSSIINRVTVFIIRFRSKPPSLPSISLFDDDFSDISSDDGDVDDLEDDDDTGNDSSSEFDDEPSASASSSFLRLDDFFFRVRGTAQNDESSRSQIDTRHRSCSIGDIFSLAELASSDSVVKLWDTIGFGLGLDFDDYEESPLHAPASSSTASPAVVVSAAEGSRGNLEVGIWDTRLRKRRPSVVAEWGPAVGKTVRVESGGVSKVYVRDNGRDGVTVGDMRKVSKPLGNVTESDADNTWWDASEEQQSSMMHQT

SEQ ID NO: 335 - DNA, 788 bp, Lactuca saligna
  misc_feature (679)..(679): n is a, c, g, or t
  misc_feature (711)..(711): n is a, c, g, or t
atggaaatcacggagctcaatctcatcggcgatttcgaagccggaatgaaatgcttacagaacccatctttactttctacagtttctctaatcgataaagttcctcggttttacagttattggacatggggtgctttgattcttgctgttttcgctactttcactagtgtatttaataggattaaattgtttatataccagatccgtctcaaacttttagcttcttgtcaaaaatcatgccctcagcagattttcggcgatgatgatttagatttggacttttccgatgacgacggcgacgatgatacaccgtcgtctgtggcagagtccgatgatgaagaattggattcagaggacggacatccggatgaagttttccgggcagagggttctagtttttggggaaacaacagagggtccgatggtaatttcacgctccgacggcgtaacgggttttcgttgtcagatttttccgccgggaagagcgttgtacagttgtgagatagttttggtttagggttagattttgaagacgatgaatccgagtacgggagtgaaattgcgatctgggatttggatcgcgacgtgaaattaagctccggaaggcgctgcgaggttgctgcagtggcggacaatgttgtcctgacggcggagatgaatggtaataacggcgaagtgnggtttcgtacgtatgattctagggtggacggncagtctccggctatttacgcgacgtggcggccacgtcaccggcaaatatgggcggacgatgaaagcgtcaccggtca

SEQ ID NO: 336 - protein, 262 aa, Lactuca saligna
  misc_feature (226)..(226): Xaa can be any naturally occurring amino acid
  misc_feature (262)..(262): Xaa can be any naturally occurring amino acid
MEITELNLIGDFEAGMKCLQNPSLLSTVSLIDKVPRFYSYWTWGALILAVFATFTSVFNRIKLFIYQIRLKLLASCQKSCPQQIFGDDDLDLDFSDDDGDDDTPSSVAESDDEELDSEDGHPDEVFRAEGSSFWGNNRGSDGNFTLRRRNGFSLSDFSAGKSVVQLDSFGLGLDFEDDESEYGSEIAIWDLDRDVKLSSGRRCEVAAVADNVVLTAEMNGNNGEVXFRTYDSRVDGQSPAIYATWRPRHRQIWADDESVTGX

SEQ ID NO: 337 - DNA, 810 bp, Lactuca sativa
atggaaatcacggagctcaatctcatcggcgatttcgaagccggaatgaaatgcttacagaacccatctttactttctacagtttctctaatcgataaagttcctcggttttacagttattggacatggggtgctttgattcttgctgttttcgctactttcactagtgtatttaataggattaaattgtttatataccagatccgtctcaaacttttaacttcttgtcaaaaatcatgcccccagcagattttcggcgatgatgatttagattttgacttttccgatgacgacggagacgatgatacaccgtcgtctgtggcagagtccgacgatgaagaattggattcagaggacggacatccggatgaagttttccgggcagagggttctagtttttggggaaacaacagagggtccgatggtaatttcacgctccgacggcgtaacgggctttcgttgtcggatttttccgccgggaagagcgttgtacagttgtgggatagttttggtttagggttagattttgaagacgatgaatccgagtacgggagtgaaattgcgatctgggatttggatcgcgacgtgaaattaagctcccgcaggcgctgcgaggttgctgcagtggcggacaatgttgtcctgacggcggagatgaatgataataacggcgaagtgggttttcgaacgtataattctagggtggacggcaagtctccggctatctacgcgacgtggcggccacgtcaccggcaaatatgggcggacgatgaaagcgtcaccggatcagaaggaagagtgagcgcgtga

SEQ ID NO: 338 - protein, 269 aa, Lactuca sativa
MEITELNLIGDFEAGMKCLQNPSLLSTVSLIDKVPRFYSYWTWGALILAVFATFTSVFNRIKLFIYQIRLKLLTSCQKSCPQQIFGDDDLDFDFSDDDGDDDTPSSVAESDDEELDSEDGHPDEVFRAEGSSFWGNNRGSDGNFTLRRRNGLSLSDFSAGKSVVQLWDSFGLGLDFEDDESEYGSEIAIWDLDRDVKLSSRRRCEVAAVADNVVLTAEMNDNNGEVGFRTYNSRVDGKSPAIYATWRPRHRQIWADDESVTGSEGRVSA

SEQ ID NO: 339 - DNA, 801 bp, Lactuca serriola
atggaaatcacggagctcaatctcatcggcgatttcgaagccggaatgaaatgcttacagaacccatctttactttctacagtttctctaatcgataaagttcctcggttttacagttattggacatggggtgctttgattcttgctgttttcgctactttcactagtgtatttaataggattaaattgtttatataccagatccgtctcaaacttttaacttcttgtcaaaaatcatgcccccagcagattttcggcgatgatgatttagattttgacttttccgatgacgacggagacgatgatacaccgtcgtctgtggcagagtccgacgatgaagaattggattcagaggacggacatccggatgaagttttccgggcagagggttctagtttttggggaaacaacagagggtccgatggtaatttcacgctccgacggcgtaacgggttttcgttgtcggatttttccgccgggaagagcgttgtacagttgtgggatagttttggtttagggttagattttgaagacgatgaatccgagtacgggagtgaaattgcgatctgggatttggatcgcgacgtgaaattaagctccggcaggcgctgcgaggttgctgcagtggcggacaatgttgtcctgacggcggagatgaatgataataacggcgaagtgggttttcgtacgtatgattctagggtggacggcaagtctccggctatctacgcgacgtggcggccacgtcaccggcaaatatgggcggacgatgaaagcgtcaccggtcagaaggaggagtga

SEQ ID NO: 340 - protein, 266 aa, Lactuca serriola
MEITELNLIGDFEAGMKCLQNPSLLSTVSLIDKVPRFYSYWTWGALILAVFATFTSVFNRIKLFIYQIRLKLLTSCQKSCPQQIFGDDDLDFDFSDDDGDDDTPSSVAESDDEELDSEDGHPDEVFRAEGSSFWGNNRGSDGNFTLRRRNGFSLSDFSAGKSVVQLWDSFGLGLDFEDDESEYGSEIAIWDLDRDVKLSSGRRCEVAAVADNVVLTAEMNDNNGEVGFRTYDSRVDGKSPAIYATWRPRHRQIWADDESVTGQKEE

SEQ ID NO: 341 - DNA, 801 bp, Lactuca virosa
atggaaatcacggagctcaatctcatcggcgatttcgaagccggaatgaaatgcttacagaacccatctttactttctacagtttctctaatcgataaagttcctcggttttatagttattggacatggggtgctttgattcttgctgttttcgctactttcactagtgtatttaataggattaaattgtttatataccagatccgtctcaaacttttaacttcttgtcaaaaatcatgcccccagcagattttcggcgatgatgatttagattttgacttttccgatgacgacggcgacgatgatacaccgtcttccgtggcagagtccgatgatgaagaattggattcagaggacggacatccggatgaagttttccgggcagagggttctagtttttggggaaacaacagagggtccgatggtaatttcacgctccgacggcgtaacgggtcttcgttgtcggatttttccgccgggaagagcgttgtacagttgtgggatagttttggtttagggttagattttgaagacgatgaatctgaatacgggagtgaaattgcgatctgggatttggatcgcgacgtgaaattaagctccggcaggcgctgcgaggttgctgcagtggcggacaatgttgtcctgacggcggagatgaatgataataacggcgaagtgggttttcgtacgtatgattctagggtggacggcaagtctccggctatctacgcgacgtggcgctcacgtcaccggcaactatgggcggacgatgaaagcgtcaccggtcagaaagaggagtga

SEQ ID NO: 342 - protein, 266 aa, Lactuca virosa
MEITELNLIGDFEAGMKCLQNPSLLSTVSLIDKVPRFYSYWTWGALILAVFATFTSVFNRIKLFIYQIRLKLLTSCQKSCPQQIFGDDDLDFDFSDDDGDDDTPSSVAESDDEELDSEDGHPDEVFRAEGSSFWGNNRGSDGNFTLRRRNGSSLSDFSAGKSVVQLWDSFGLGLDFEDDESEYGSEIAIWDLDRDVKLSSGRRCEVAAVADNVVLTAEMNDNNGEVGFRTYDSRVDGKSPAIYATWRSRHRQLWADDESVTGQKEE

SEQ ID NO: 343 - DNA, 924 bp, Malus domestica
atggaaatcccagtgctcaatagaattacagatcttccttcccgcctgacctccttgccggacccatcttttctttcccagagtttatcgattcccggaatccaaaacgtctctcaagcttacagtttctggaaatggggagctctaatcctcgcaattcttgcttccttcggcaccctcatcactaaaatcaacatttttgccatcagtctccgccgcctccggttattggccccgcagccgctttcccagcagcgccacgacggcgattactccgacgtcagcgatgacgacgatatctgctctgtttcgtcagcttcctccgtatccgatgacgaatcggaatccgaaatatcgtacgacgacgaaagcagaacgattgggagagatgaacatttccacgtcagaggctctgggtattacggcgacgacggagagcagaatcgtaacttgggactccgcctccgcagaagcttcggaggccatcgattctcatggtctgacttcgcggccggcaaaagcgtcgtcaagctctgggactcgtcgtctccgtctacgtttctgtctgctgactcgggcgtgtcggggcgcgtgtcgctaggtgtttgggacgcgcgcgtcggatgtcggattccggcgatactcgctgattggggcccgcagctcgggagaatggttggagtggcgtcaggcgtcgacgataaggtttacgtcaaggatggcgtaaccggtaaagtgacgattggtgacgtgaggaaagtggcgtcgccgttagggaatgtaacgggagcagacttggatgatacgtggtgggacgctgacgcggttgttgtgacggacgagcgttttgacgagtcagccatgcgtggatgtgactcggccgtcacgcggtgctgtagcgctgttaggtcttatctgttgtaa

SEQ ID NO: 344 - protein, 307 aa, Malus domestica
MEIPVLNRITDLPSRLTSLPDPSFLSQSLSIPGIQNVSQAYSFWKWGALILAILASFGTLITKINIFAISLRRLRLLAPQPLSQQRHDGDYSDVSDDDDICSVSSASSVSDDESESEISYDDESRTIGRDEHFHVRGSGYYGDDGEQNRNLGLRLRRSFGGHRFSWSDFAAGKSVVKLWDSSSPSTFLSADSGVSGRVSLGVWDARVGCRIPAILADWGPQLGRMVGVASGVDDKVYVKDGVTGKVTIGDVRKVASPLGNVTGADLDDTWWDADAVVVTDERFDESAMRGCDSAVTRCCSAVRSYLL

SEQ ID NO: 345 - DNA, 945 bp, Medicago truncatula
atgcaagttccattaattgatagactcaacgatttccaagcaggtttcaattcattacaacaaaacccatctttcccttcacaaatcacagccacttccttcaatggaatccaatccgtttccattgctttcaatttctgcaaatggggtgctgttattcttgccttagtcgcaactttcaccagcctcatcaacaaagtcaccattttcatcatccaccttcgtaaaaaagcttcttcccttccatcaatcaccttcgacaacgacgatgatttcagctccgatgatgaagataacgaaaacgatgacattgttagcttatcttcgtcatcggaatttgaagacgatgaaccatctatgtcatcttcatcaagcttcaaagatttctttcgccttacaggaaacagtaacgattacgatgtgaacaacgtattccaaactcaaaacagtgggcatagacgacaacatagtattggtgattttttttctcttttagaattagccaatggtgataacgttgttaagctttgggacagtataggatttggtttaggtttagatttcgatgaatacgaggatggtgttatttcttctaccaacccacatgcgcctttaacttctgcggctgcatcaccagatgtgattgtttccgcaggagaaggcgcacatggtaatcttgcagtcgagatatgggacactcgtctccgacgacggaagccgtcggtcgtagccgagtggggacccacggtggggaacacgctgcgcgtggaatctggcggcgttcagaaagtttatgtcagagataacggacgtcagcgtttgacggttggtgatatgagaaaagtcagttttccgttaggaaatgtaacggaatctgacgcggataatacttggtgggatgctgatgctgttattgttacagatgaatcttacggaaaacattaa

SEQ ID NO: 346 - protein, 314 aa, Medicago truncatula
MQVPLIDRLNDFQAGFNSLQQNPSFPSQITATSFNGIQSVSIAFNFCKWGAVILALVATFTSLINKVTIFIIHLRKKASSLPSITFDNDDDFSSDDEDNENDDIVSLSSSSEFEDDEPSMSSSSSFKDFFRLTGNSNDYDVNNVFQTQNSGHRRQHSIGDFFSLLELANGDNVVKLWDSIGFGLGLDFDEYEDGVISSTNPHAPLTSAAASPDVIVSAGEGAHGNLAVEIWDTRLRRRKPSVVAEWGPTVGNTLRVESGGVQKVYVRDNGRQRLTVGDMRKVSFPLGNVTESDADNTWWDADAVIVTDESYGKH

SEQ ID NO: 347 - DNA, 663 bp, Nicotiana tabacum
atggatttcacagaaattaacatgatcagcgattttgaagcaggtgtgaaatgtctacaaaacccttctttaatttctcgattcttttcactttcagaagtaacccaaatttacagtttctggaaatggggcgctttaattcttgcagttgtagccacttttagcagcctaataagaaaaatcaaacttttgttcatttacgtttttacccttaaaccttcggctgaacctctccttcaataccttggcgaagacttcgatatttcagagtccgacgatgaagacgataaatgctcaacaccgccgtcttctgacgatgaagacctcattgatcggcaaatcgatgaagattttagagtatcaggttcgagtttctattttaaggagcaaggtcaaaattgtaatttgagacttcgaaggcagcggaatagttttgagcggttcccgtggacggaattttctgccggaaaaaatgtcgtgaagctgtgggatagtttagcgttaggtttagattatgagtatgatgatttatctaaaagtgtagtgtcgctatgggatttgaatgcggagcagaaaattagcgatatttttagcggttcttctcagttccagcggtggcgacggcgtcaccatcggtggttttgtcatcggagtgaaaaatga

SEQ ID NO: 348 - protein, 220 aa, Nicotiana tabacum
MDFTEINMISDFEAGVKCLQNPSLISRFFSLSEVTQIYSFWKWGALILAVVATFSSLIRKIKLLFIYVFTLKPSAEPLLQYLGEDFDISESDDEDDKCSTPPSSDDEDLIDRQIDEDFRVSGSSFYFKEQGQNCNLRLRRQRNSFERFPWTEFSAGKNVVKLWDSLALGLDYEYDDLSKSVVSLWDLNAEQKISDIFSGSSQFQRWRRRHHRWFCHRSEK

SEQ ID NO: 349 - DNA, 936 bp, Ocimum basilicum
atggaaatccccgagataaacatgttgagtgatttcgaagcaggaatgaaatgcctgcaaaacccctcattcatctcccgtttgtcttcgtttccaaccttctggaaatggggcgccttgattttcgctattttcgccacatttagcagcgttatcagaagaattaagcttattctcatccgttttcatactgtaaaatccccctctaatcccacggtcgatgctttcgagttcagcgacgacgaagacaacgtcgtttcaccagcgtcttctgatgatgaccgaggcggagaagaagaagaagatcgccccacaacgtcgtttagtggtcaacaccgcgttgatgaaaatttctgcgtcaggggttcgattcacagctttaaaacccaggggcagaatggtcaattgaggcagcgcaggcggcggagctgcggcaacgcttggtcgggattcgcttctggtaaaaatgttgttaagctttgggatagtttaggattcagtctagatattgatgaagatttatttaattacgatccgaaaagcgtagtttctacgtgggatcattatcaagagcaaaatccaaccaatttctccggcggggtctggggtgcatcggcggccgcgccgacggtgttgttgacggcggagggtaacggaaagggtgacggcgtgatcttgggcggttacgatacgaggatgagaagtagtgccccggcgttgtacgccgaatggagatcgccggcgaagaaacgcggcggcgttccaaccaccggcgtggggaaggtttatgtcagagatgacgtgagcggagtggtaacggttggtgatgtgcggaatgtgaggcggccgttagaaagcgcgagagagtctgacggcgatacctggtgggacgctgacgccgttattgttgaaaacgaatttgagtcttccaagtaa

SEQ ID NO: 350 - protein, 311 aa, Ocimum basilicum
MEIPEINMLSDFEAGMKCLQNPSFISRLSSFPTFWKWGALIFAIFATFSSVIRRIKLILIRFHTVKSPSNPTVDAFEFSDDEDNVVSPASSDDDRGGEEEEDRPTTSFSGQHRVDENFCVRGSIHSFKTQGQNGQLRQRRRRSCGNAWSGFASGKNVVKLWDSLGFSLDIDEDLFNYDPKSVVSTWDHYQEQNPTNFSGGVWGASAAAPTVLLTAEGNGKGDGVILGGYDTRMRSSAPALYAEWRSPAKKRGGVPTTGVGKVYVRDDVSGVVTVGDVRNVRRPLESARESDGDTWWDADAVIVENEFESSK

SEQ ID NO: 351 - DNA, 930 bp, Phaseolus vulgaris
atgcaagttccgttgatagacagaatcaacgatcttcaagtgggtctcaactctctgcaaaacccatcctttccttctcagatcacaacttccctcgcttccgtatccatagcatacaatttctgcaaatggggcgcagtgattctcgccctagtcgctactttcggcagcataatcaacagagtcaccattttcatccttcgattccgcaccaaagccccttctcttccctcaaacgatgaatacgacgacgtttactcctccactgacgacgacgacgactacgaaaacgacgacgatttaacctacttgtcctccgacctcgaagacgaaccctccgcgtcttccagcttcattcgtttggaagactatttccgactcagaggaacgcccgataacgaccacaaccaaaacgacgacttccagacccaaaacggcacgcacaaacgatgtcgcagcatcggcgatattttctcgctctcggaactcgccaacagcaagagcgtcgtgaagctctgggacagcataggcttcgggctgggcttagatttcgatgattacgaggacggcgtcgtttccacttacgacccggcgaactccacggcgtcgcccgcggtgctggtctcggccggggagggcgcgtgcgggaaccttgcggtggaggtttgggacacgcgcctgcggcggcggaagccgtcggtggttgcggagtggggaccctccatgggcaagactctgcgcgtggaatctggcggcgtgcagaaggtttatgtgagagatgacggacgtcacggcgtgacggtcggggacatgagaaacgtcagcacgccgttaggcaacatgacggaatctgacgcggatacttggtgggatgcggacgcaattgttgtttcggacgagcagcaatcaatgttgcagcaaccaacttga

SEQ ID NO: 352 - protein, 309 aa, Phaseolus vulgaris
MQVPLIDRINDLQVGLNSLQNPSFPSQITTSLASVSIAYNFCKWGAVILALVATFGSIINRVTIFILRFRTKAPSLPSNDEYDDVYSSTDDDDDYENDDDLTYLSSDLEDEPSASSSFIRLEDYFRLRGTPDNDHNQNDDFQTQNGTHKRCRSIGDIFSLSELANSKSVVKLWDSIGFGLGLDFDDYEDGVVSTYDPANSTASPAVLVSAGEGACGNLAVEVWDTRLRRRKPSVVAEWGPSMGKTLRVESGGVQKVYVRDDGRHGVTVGDMRNVSTPLGNMTESDADTWWDADAIVVSDEQQSMLQQPT

SEQ ID NO: 353 - DNA, 942 bp, Solanum lycopersicum
atggagttccctgagatcaacatgatcagcgattttgaagcaggggtgaaatgtcttcaaaacccatctatggtttctcgattcttttcactttctcccattgaaaaagtacctcaagtttacagtttttggaaatggggtgctttaattctcgccattctagctactttcagcagcttaataagaaaaatcaagctattgttcatttacgttcgtagaatcaaaccttctgctgaaccccttcttcaatatctaggcgaagacttcgatatttccgatgatgatgacgaagatgataaatgttcatcggcggcggcgccgtcttctgatgatgaggatctattagatcaacaaattgatgaagattttactgttgccgggtcgtgtttttatttcagggaaaaagggaatttgagattccgtcggcggagaaatagcttagagaggtttccatggacggaattttcagccgggaagaatgttgtaaagctatgggatagtttagctttaggattagattatgaatacgaagatttatcgaacagtgtagtttcgttatgggatttgaaccaggaagagaaaataggaaatttatttactgggtcttctaaggtaccgtcggtagcaatggcgtcgccgtcgatggttttgtcatcggaagtgaaaaacgacaggaacggtgttgttttagctgcgtatgatacgaggatgagaagtaattctccggcgatatatgctgactggggtaaaggatcagggaaggtcgtcggagttaatggttccggcgtcggaaaagtttacgtcagaaatgaatccgccgggaagttgacggtcggtgatttgagaaacgtgaaaacgccgttagagaaaattgacggtgacacgtggtgggacgcagacgccgttattgtcgaggagaaatttgacggttcaaaaaattga

SEQ ID NO: 354 - protein, 313 aa, Solanum lycopersicum
MEFPEINMISDFEAGVKCLQNPSMVSRFFSLSPIEKVPQVYSFWKWGALILAILATFSSLIRKIKLLFIYVRRIKPSAEPLLQYLGEDFDISDDDDEDDKCSSAAAPSSDDEDLLDQQIDEDFTVAGSCFYFREKGNLRFRRRRNSLERFPWTEFSAGKNVVKLWDSLALGLDYEYEDLSNSVVSLWDLNQEEKIGNLFTGSSKVPSVAMASPSMVLSSEVKNDRNGVVLAAYDTRMRSNSPAIYADWGKGSGKVVGVNGSGVGKVYVRNESAGKLTVGDLRNVKTPLEKIDGDTWWDADAVIVEEKFDGSKN

SEQ ID NO: 355 - DNA, 801 bp, Taraxacum officinale
atggaaatcacggagctcaatctcatcggagatttcgaagccgggatgaaatgcttgcagaacccatcgttactttctaaagtttctttaatcgataaagttcctcgcttttacagttttttgacatggggtgctttgattcttgctgtttttgctaccttcactagtgtatttaataggattaaattgttcatataccagatccgtcttaaaattttagcttcttgtcaaaaatcatgcccccagcagattttcggcgatgatgatttcgattttgactcttccgacgacgacggtgacgatgatacgccgtcgtccgtggcggagtccgatgatgaggaattggattcggaggacggacacgcggatgaagttttccgggcagagggttctagtttttgggggaataacagaggacctgacggtaatttcacgctccgacgacgtaacgggttttcattgtcggattttaccgccgggaagagtgtggtacagttgtgggatagtttcgggttagggttagattttgaagacgatgaatctgactacgggagtgaaattgcgatctgggacttggatcgggacgtgaagttaagctccggcaggcgctgcaaggttgcggcagcgtcggacaatgttgtgttgacggcggagatgaatgaaagtaacggcggagtgggttttagtacatatgattctagggtggatgagaagtctccggctatctacgcgacgtggcggccacgtcaccggcagatttggtccgaagatgaaagcgtcaccggtgagaaggaggagtga

SEQ ID NO: 356 - protein, 266 aa, Taraxacum officinale
MEITELNLIGDFEAGMKCLQNPSLLSKVSLIDKVPRFYSFLTWGALILAVFATFTSVFNRIKLFIYQIRLKILASCQKSCPQQIFGDDDFDFDSSDDDGDDDTPSSVAESDDEELDSEDGHADEVFRAEGSSFWGNNRGPDGNFTLRRRNGFSLSDFTAGKSVVQLWDSFGLGLDFEDDESDYGSEIAIWDLDRDVKLSSGRRCKVAAASDNVVLTAEMNESNGGVGFSTYDSRVDEKSPAIYATWRPRHRQIWSEDESVTGEKEE

SEQ ID NO: 357 - DNA, 918 bp, Trametes versicolor
tcatttaattaataatttcttacaattttctaatttggactttggaccaaatctttgccatttttgccctcttaaaatcaattccaatctggccaagtcagccaattagcccagcaaagagtaacccgaacccgttatatacgttgacccgatcaattttcatcttccacaataacggcgtcagcgtcccaccaggtctcgccgttagactctctcacactttctaacgggcgcctaacatttctcacgtcaccaacagttagcttcccgctgacgccatccttaacgtagaccttcccaacaccgccgacagcgacggcggcggatactttctccaccgcctccgtcaatccccaatcggcgtagaacgccggagaacggcttttcatcctcgtatcaaaaccacccaaaaccacgccctcccccttccgattactctccgccgtgaaaaccaccgtagcagatgccgccggaatatcccaatccccaccgaaaaaatcattttttttcaaatctcgatcataatcccaagttgaaaccacgctttgcccaccgaagttgaataaatcctcatcaaaatctaaactcaaacctaagctatcccaaagcttaactacgcttttaccaggagcaaaatccgaccacgcgccgccgcagctcctctgcctacgctgccgcaaacggccagtagaccaacccttcacacgagaatcctggccaacgcgatgttggcctcgaaacgacgtcgtttggcgactttccctttcttcttgttcatcctcatcatcagaagatgctaatgagatatcatcatcatcgtcatcatcgctaaactcaaaaatctcatcttttttaattgaagatggtttaacagtatgtaaacggattaaaacaagcttaattcttctgattaagctg

SEQ ID NO: 358 - protein, 305 aa, Trametes versicolor
MEITELNMISDFQAGIKCLQSPSLISRFFSFQVYSFCKWGALIFAIFATFSSLIRRIKLVLIRLHTVKPSSIKKDEIFEFSDDDDDDDISLASSDDEDEQEERESRQTTSFRGQHRVGQDSRVKGWSTGRLRQRRQRSCGGAWSDFAPGKSVVKLWDSLGLSLDFDEDLFNFGGQSVVSTWDYDRDLKKNDFFGGDWDIPAASATVVFTAESNRKGEGVVLGGFDTRMKSRSPAFYADWGLTEAVEKVSAAVAVGGVGKVYVKDGVSGKLTVGDVRNVRRPLESVRESNGETWWDADAVIVEDEN

SEQ ID NO: 359 - DNA, 1074 bp, Vitis vinifera
atggaaatcccgatcatcaacagaatgagtaatttcgatgatccatctgttctttctcgccttttccccatttctcaaatttctcaaccatttagtttatggaaatggggggctttaatacttgcactactcgctactttcaccagcataatcaatagaaccaaaattttgatcataaggttgcggaaacgtagttctttagctgcacaaccgctgcactcagagcctgacgacggcgggttcagtgacagcgaagacgatacatgctcatcgatttcttccgatgacgatgacgacgccgaacccatgtctctaatcgaggatgacaaaaatgttcgggtcggttattgcgaggatgaaccgcaaagtcacaaaacgaagctcaggagatgtcggagcatcggagaccgcctctttttgtcggagttgactaacggcaagagcatcgttaagctttgggacggcctgtccctcgataactcctgcggcagtttagtttccatttatgatttgaataaggatctgaacaaaagctcattttttggcgggacacatcggtttccgtccgtgtcggtgacttcgcccgctgtagtggtatcgacgatgacaggaaatgccatgaatacggcattgcgagtgtgggacacgagagtcgggcgtcagatcccggcgatattcgccgagtggagacctcaaatgggaaaaagggtgagcatcagcaccggcggcatcgagaaggtttatgtcagagatgacgtcacgggagagttaacggtgggagacatgaggaacgccagctcaccgttacaaaatgtaacggagtgcgacggaggaacctggtgggacgctgacgccgttatggtatacaaagactatgttgaccagttcatgtattctagatatgtccctctattaaataaactgctttcatacattcaccctctcttctcgatgcttttgtctttcactcttttcactcctccttggatctaccattcatcactcatcatttctctctccgtctgtctgtctgtctctctctcttttccttgtcaaacaacattctttgaatga

SEQ ID NO: 360 - protein, 357 aa, Vitis vinifera
MEIPIINRMSNFDDPSVLSRLFPISQISQPFSLWKWGALILALLATFTSIINRTKILIIRLRKRSSLAAQPLHSEPDDGGFSDSEDDTCSSISSDDDDDAEPMSLIEDDKNVRVGYCEDEPQSHKTKLRRCRSIGDRLFLSELTNGKSIVKLWDGLSLDNSCGSLVSIYDLNKDLNKSSFFGGTHRFPSVSVTSPAVVVSTMTGNAMNTALRVWDTRVGRQIPAIFAEWRPQMGKRVSISTGGIEKVYVRDDVTGELTVGDMRNASSPLQNVTECDGGTWWDADAVMVYKDYVDQFMYSRYVPLLNKLLSYIHPLFSMLLSFTLFTPPWIYHSSLIISLSVCLSVSLSFPCQTTFFE

SEQ ID NO: 361 - DNA, 56 bp, Artificial sequence
  primer: prm14292
ggggacaagtttgtacaaaaaagcaggcttaaacaatggagatcccagtgatcaat

SEQ ID NO: 362 - DNA, 49 bp, Artificial sequence
  primer: prm14293
ggggaccactttgtacaagaaagctgggtccgcgttatcaaacagattt

SEQ ID NO: 363 - DNA, 2194 bp, Artificial sequence; identical to SEQ ID NO: 156
  Promoter

SEQ ID NO: 364 - protein, 15 aa, Artificial sequence
  motif 27 a
  VARIANT (2)..(2): / replace = "Asn"
  VARIANT (4)..(4): / replace = "Cys"
  VARIANT (5)..(5): / replace = "Thr"
  VARIANT (13)..(13): / replace = "Val"
  VARIANT (14)..(14): / replace = "Val" / replace = "Leu"
YSFWKWGALILALFA

SEQ ID NO: 365 - protein, 15 aa, Artificial sequence
  motif 27 b
YSFWKWGALILALAA

SEQ ID NO: 366 - protein, 12 aa, Artificial sequence
  motif 28 a
  VARIANT (3)..(3): / replace = "Val"
  VARIANT (4)..(4): / replace = "Thr"
  VARIANT (5)..(5): / replace = "Glu"
  VARIANT (6)..(6): / replace = "Leu"
  VARIANT (8)..(8): / replace = "Leu"
  VARIANT (10)..(10): / replace = "Gly"
MEIPVINRISDF

SEQ ID NO: 367 - protein, 12 aa, Artificial sequence
  motif 28 b
MEIPVINRISDF

SEQ ID NO: 368 - protein, 11 aa, Artificial sequence
  motif 29 a
  VARIANT (1)..(1): / replace = "Asn"
  VARIANT (4)..(4): / replace = "Gln"
  VARIANT (8)..(8): / replace = "Asn"
  VARIANT (11)..(11): / replace = "Phe"
SVVKLWDSLGL

SEQ ID NO: 369 - protein, 11 aa, Artificial sequence
  motif 29 b
NVVKLWDNLGL

SEQ ID NO: 370 - protein, 50 aa, Artificial sequence
  motif 30 a
  VARIANT (3)..(3): / replace = "Ile"
  VARIANT (4)..(4): / replace = "Leu"
  VARIANT (6)..(6): / replace = "Val"
  VARIANT (9)..(9): / replace = "Val"
  VARIANT (10)..(10): / replace = "Glu"
  VARIANT (12)..(12): / replace = "Ile"
  VARIANT (13)..(13): / replace = "His"
  VARIANT (15)..(15): / replace = "Thr"
  VARIANT (17)..(17): / replace = "Ser" / replace = "His"
  VARIANT (18)..(18): / replace = "Leu"
  VARIANT (29)..(29): / replace = "Ala" / replace = "Val"
  VARIANT (33)..(33): / replace = "Ser"
  VARIANT (34)..(34): / replace = "Ala"
  VARIANT (39)..(39): / replace = "Ile"
  VARIANT (41)..(41): / replace = "Ile"
  VARIANT (43)..(43): / replace = "Val"
  VARIANT (44)..(44): / replace = "Val"
  VARIANT (45)..(45): / replace = "Arg"
  VARIANT (46)..(46): / replace = "Phe"
  VARIANT (47)..(47): / replace = "Lys"
  VARIANT (48)..(48): / replace = "Asn"
SQVSALSGIGKFYQAYNFWKWGALILALIASFTTIINRVKALIIKLQKHP

SEQ ID NO: 371 - protein, 50 aa, Artificial sequence
  motif 30 b
SQILALSGVEKIHQAYSFWKWGALILALAASFTAIINRIKILIIRFKNHP

SEQ ID NO: 372 - protein, 21 aa, Artificial sequence
  motif 31 a
  VARIANT (1)..(1): / replace = "Asp" / replace = "Glu"
  VARIANT (2)..(2): / replace = "Phe"
  VARIANT (4)..(4): / replace = "Asn"
  VARIANT (7)..(7): / replace = "Ser"
  VARIANT (19)..(19): / replace = "Phe"
MMTSGKNVVKLWDNLGLGLGL

SEQ ID NO: 373 - protein, 21 aa, Artificial sequence
  motif 31 b
DFTNGKNVVKLWDNLGLSLGL

SEQ ID NO: 374 - protein, 21 aa, Artificial sequence
  motif 30 a
  VARIANT (4)..(4): / replace = "Pro"
  VARIANT (6)..(6): / replace = "Val"
  VARIANT (10)..(10): / replace = "Ser"
  VARIANT (14)..(14): / replace = "Ala"
  VARIANT (15)..(15): / replace = "Gly" / replace = "Ser"
  VARIANT (16)..(16): / replace = "Leu"
  VARIANT (17)..(17): / replace = "Ala" / replace = "Ser"
  VARIANT (18)..(18): / replace = "Ser"
  VARIANT (19)..(19): / replace = "Leu"
  VARIANT (20)..(20): / replace = "Gln"
  VARIANT (21)..(21): / replace = "Asn"
MEILVINRIIDFETNINPSLV

SEQ ID NO: 375 - protein, 21 aa, Artificial sequence
  motif 32b
MEIPVINRISDFETGLASLQN

The invention claimed is:

1. A method for increasing plant yield in a plant relative to a control plant, comprising introducing and expressing in a plant a nucleic acid encoding a CER2-like (CER2-like acyl transferase) polypeptide having acyltransferase activity, wherein said CER2-like polypeptide is selected from the group consisting of:
   (a) a polypeptide encoded by the nucleic acid sequence of SEQ ID NO: 168;
   (b) a polypeptide comprising the amino acid sequence of SEQ ID NO: 169; and
   (c) a polypeptide having at least 95% sequence identity to the amino acid sequence of SEQ ID NO: 169.

2. The method of claim 1, wherein said CER2-like polypeptide comprises the amino acid sequence of SEQ ID NO: 169.

3. The method of claim 1, wherein said CER2-like polypeptide is encoded by a nucleic acid comprising the nucleotide sequence of SEQ ID NO: 168.

4. The method of claim 1, wherein said nucleic acid is operably linked to a constitutive promoter, a medium strength constitutive promoter, a plant promoter, a GOS2 promoter, or a GOS2 promoter from rice.

5. The method of claim 1, wherein said increased plant yield comprises increased biomass and/or increased seed yield relative to a control plant.

6. The method of claim 5, wherein said increased seed yield comprises increased total weight of seeds, increased number of filled seeds, increased seed fill rate, and/or increased harvest index.

7. The method of claim 1, wherein said increased plant yield is obtained under non-stress conditions.

8. The method of claim 1, wherein said increased plant yield is obtained under conditions of drought stress, salt stress or nitrogen deficiency.

9. A plant obtained by the method of claim 1, or a plant cell, plant part, seed, or progeny thereof, wherein said plant, or said plant cell, plant part, seed, or progeny thereof, comprises a recombinant nucleic acid encoding said CER2-like polypeptide.

10. A construct comprising:
   (i) a nucleic acid encoding a CER2-like polypeptide having acyltransferase activity;
   (ii) one or more heterologous control sequences capable of driving expression of the nucleic acid sequence of (i); and optionally
   (iii) a transcription termination sequence,
   wherein said CER2-like polypeptide is selected from the group consisting of:
   (a) a polypeptide encoded by the nucleic acid sequence of SEQ ID NO: 168;
   (b) a polypeptide comprising the amino acid sequence of SEQ ID NO: 169; and
   (c) a polypeptide having at least 95% sequence identity to the amino acid sequence of SEQ ID NO: 169.

11. The construct of claim 10, wherein one of said control sequences is a constitutive promoter, a medium strength constitutive promoter, a plant promoter, a GOS2 promoter, or a GOS2 promoter from rice.

12. A plant, plant part or plant cell comprising the construct of claim 10.

13. A method for making a plant having increased seed yield and/or increased biomass relative to a control plant, comprising introducing the construct of claim 10 into a plant or plant cell, and selecting for a plant having increased seed yield and/or increased biomass relative to a control plant.

14. A method for the production of a transgenic plant having increased plant yield relative to a control plant, comprising:
   (i) introducing and expressing in a plant or plant cell a nucleic acid encoding a CER2-like polypeptide having acyltransferase activity; and
   (ii) cultivating said plant or plant cell under conditions promoting plant growth and development; and optionally
   (iii) selecting for a plant having increased plant yield relative to a control plant, wherein said CER2-like polypeptide is selected from the group consisting of:
   (a) a polypeptide encoded by the nucleic acid sequence of SEQ ID NO: 168;
   (b) a polypeptide comprising the amino acid sequence of SEQ ID NO: 169; and
   (c) a polypeptide having at least 95% sequence identity to the amino acid sequence of SEQ ID NO: 169.

15. The method of claim 14, wherein said increased plant yield comprises increased biomass and/or increased seed yield relative to a control plant.

16. The method of claim 15, wherein said increased seed yield comprises increased total weight of seeds, increased number of filled seeds, increased seed fill rate, and/or increased harvest index.

17. A plant obtained by the method of claim 14, or a plant cell, plant part, seed, or progeny thereof, wherein said plant, or said plant cell, plant part, seed, or progeny thereof, comprises a recombinant nucleic acid encoding said CER2-like polypeptide.

18. A transgenic plant having increased biomass and/or increased seed yield relative to a control plant, resulting from introducing and expressing a recombinant nucleic acid encoding a CER2-like polypeptide having acyltransferase activity, or a transgenic plant cell derived from said transgenic plant, wherein said CER2-like polypeptide is selected from the group consisting of:

(a) a polypeptide encoded by the nucleic acid sequence of SEQ ID NO: 168;
(b) a polypeptide comprising the amino acid sequence of SEQ ID NO: 169; and
(c) a polypeptide having at least 95% sequence identity to the amino acid sequence of SEQ ID NO: 169.

19. The transgenic plant of claim 18, wherein said nucleic acid is operably linked to a constitutive promoter, a medium strength constitutive promoter, a plant promoter, a GOS2 promoter, or a GOS2 promoter from rice.

20. The transgenic plant of claim 18, wherein said plant is a crop plant, a monocotyledonous plant, or a cereal, or wherein said plant is beet, sugarbeet, alfalfa, sugarcane, rice, maize, wheat, barley, millet, rye, triticale, sorghum, emmer, spelt, secale, einkorn, teff, milo or oats.

21. A harvestable part of the transgenic plant of claim 18, wherein said harvestable part comprises a recombinant nucleic acid encoding said CER2-like polypeptide.

22. The harvestable part of claim 21, wherein said harvestable part is shoot biomass and/or seed.

23. A product derived from the transgenic plant of claim 18 or a harvestable part of said plant, wherein said product comprises a recombinant nucleic acid encoding said CER2-like polypeptide.

24. The construct of claim 10, wherein said CER2-like polypeptide comprises the amino acid sequence of SEQ ID NO: 169 or is encoded by a nucleic acid comprising the nucleotide sequence of SEQ ID NO: 168.

25. The method of claim 14, wherein said CER2-like polypeptide comprises the amino acid sequence of SEQ ID NO: 169 or is encoded by a nucleic acid comprising the nucleotide sequence of SEQ ID NO: 168.

26. The method of claim 14, wherein said nucleic acid is operably linked to a constitutive promoter, a medium strength constitutive promoter, a plant promoter, a GOS2 promoter, or a GOS2 promoter from rice.

27. The transgenic plant of claim 18, wherein said CER2-like polypeptide comprises the amino acid sequence of SEQ ID NO: 169 or is encoded by a nucleic acid comprising the nucleotide sequence of SEQ ID NO: 168.

* * * * *